United States Patent 12,508,308 (INFLUENZA mRNA VACCINES) - sequence listing, part 23

SEQ ID NO: 85815 - RNA, 1410 nt, Artificial Sequence; identical to SEQ ID NO: 83154
  derived and/or modified sequence opt1 from neuraminidase__InfluenzaA__AHL96667

SEQ ID NO: 85816 - RNA, 1410 nt, Artificial Sequence; identical to SEQ ID NO: 83154
  derived and/or modified sequence opt1 from neuraminidase__InfluenzaA__AHL96679

SEQ ID NO: 85817 - RNA, 1410 nt, Artificial Sequence; identical to SEQ ID NO: 83154
  derived and/or modified sequence opt1 from neuraminidase__InfluenzaA__AHL96691

SEQ ID NO: 85818 - RNA, 1410 nt, Artificial Sequence; identical to SEQ ID NO: 83154
  derived and/or modified sequence opt1 from neuraminidase__InfluenzaA__AHL96703

SEQ ID NO: 85819 - RNA, 1410 nt, Artificial Sequence; identical to SEQ ID NO: 84879
  derived and/or modified sequence opt1 from neuraminidase__InfluenzaA__AHL96763

SEQ ID NO: 85820 - RNA, 1410 nt, Artificial Sequence; identical to SEQ ID NO: 85732
  derived and/or modified sequence opt1 from neuraminidase__InfluenzaA__AHL96787

SEQ ID NO: 85821 - RNA, 1410 nt, Artificial Sequence
  derived and/or modified sequence opt1 from neuraminidase__InfluenzaA__AHL96799
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggacgagaccgaggugcucuggaccagcaacuccaucgucguguucugcgggacgagcggcaccuacgggaccggcuccuggcccgacggggccgaccugaaccugaugcccaucuga

SEQ ID NO: 85822 - RNA, 1410 nt, Artificial Sequence; identical to SEQ ID NO: 84891
  derived and/or modified sequence opt1 from neuraminidase__InfluenzaA__AHL96811

SEQ ID NO: 85823 - RNA, 1410 nt, Artificial Sequence; identical to SEQ ID NO: 84891
  derived and/or modified sequence opt1 from neuraminidase__InfluenzaA__AHL96823

SEQ ID NO: 85824 - RNA, 1410 nt, Artificial Sequence; identical to SEQ ID NO: 83154
  derived and/or modified sequence opt1 from neuraminidase__InfluenzaA__AHL96847

SEQ ID NO: 85825 - RNA, 1410 nt, Artificial Sequence
  derived and/or modified sequence opt1 from neuraminidase__InfluenzaA__AHL96859
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85826 - RNA, 1410 nt, Artificial Sequence
  derived and/or modified sequence opt1 from neuraminidase__InfluenzaA__AHL96871
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggaggugcugcgcacccaggagagcgagugcgucugcaucaacgggacgugcgccguggugaugaccgacggcuccgccagcggcaaggcggacaccaagauccuguucaucgaggaggggaagaucguccacaccagcacgcucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacacgccccggaagaacgaccgcuccagcuccagccacugccuggaccccaacaacgaggagggcgggcacggcgucaaggggugggccuucgacgacggcaacgacguguggaugggccggaccaucaacgagaccucccgccucggguacgagaccuucaaggugaucgagggcuggagcaacccgaaguccaagcugcagaucaaccggcaggucaucguggaccgcggggaccggagcggcuacuccgggaucuucagcguggagggcaaguccugcaucaaccgcugcuucuacgucgagcugauccggggccgcaaggaggagaccgaggugcucuggaccagcaacagcaucguggucuucugcgggaccuccggcacguacgggaccggcagcuggcccgacggggccgaccugaaccugaugcccaucuga

SEQ ID NO: 85827 - RNA, 1410 nt, Artificial Sequence
  derived and/or modified sequence opt1 from neuraminidase__InfluenzaA__AHL96883
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagagcgccgaguaccggaacugguccaagccgcagugcgggaucaccggcuucgcgcccuucagcaaggacaacuccauccgccugagcgccgggggcgacaucugggucacccgggagcccuacguguccugcgaccccgacaagugcuaccaguucgcccuggggcagggcaccacgcucaacaacaugcacagcaacaacaccgugcgcgaccggaccccguaccgcacccugcugaugaacgagcucggcguccccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcgugguguccuggagcaaggagauccugcgcacccaggaguccgagugcgucugcaucaacgggacgugcaccguggugaugaccgacggcagcgccagcggcaaggccgacaccaagauccuguucaucgaggaggggaagaucguccacacguccacccucagcggcuccgcgcagcacguggaggagugcagcugcuacccccgguaccccggggugcgcugcgucugccgggacaacuggaagggcuccaaccgcccgaucguggacaucaacaucaaggaccacagcaucguguccagcuacgucugcuccggccuggugggggacacgccccggaagaacgacagcuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaaccccaaguccaagcugcagaucaaccgccaggucaucguggaccgcggggaccggagcggcuacuccgggaucuucagcguggagggcaagagcugcaucaaccggugcuucuacgucgagcugauccgcggccggaaggaggagaccgaggugcucuggaccuccaacagcaucguggucuucugcgggacguccggcaccuacgggaccggcagcuggccggacggggccgaccugaaccugaugcccaucuga

SEQ ID NO: 85828 - RNA, 1410 nt, Artificial Sequence; identical to SEQ ID NO: 84879
  derived and/or modified sequence opt1 from neuraminidase__InfluenzaA__AHL96895

SEQ ID NO: 85829 - RNA, 1410 nt, Artificial Sequence
  derived and/or modified sequence opt1 from neuraminidase__InfluenzaA__AHL96907
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggaggugcugcgcacccaggagagcgagugcgucugcaucaacgggacgugcgccguggugaugaccgacggcuccgccagcggcaaggcggacaccaagauccuguucaucgaggaggggaagaucguccacaccagcacgcucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggaccagcggcacguacgggaccggcuccuggcccgacggggccgaccugaaccugaugcccaucuga

SEQ ID NO: 85830 - RNA, 1410 nt, Artificial Sequence; identical to SEQ ID NO: 84891
  derived and/or modified sequence opt1 from neuraminidase__InfluenzaA__AHL96919

SEQ ID NO: 85831 - RNA, 1410 nt, Artificial Sequence; identical to SEQ ID NO: 84891
  derived and/or modified sequence opt1 from neuraminidase__InfluenzaA__AHL96931

SEQ ID NO: 85832 - RNA, 1410 nt, Artificial Sequence; identical to SEQ ID NO: 84891
  derived and/or modified sequence opt1 from neuraminidase__InfluenzaA__AHL96943

SEQ ID NO: 85833 - RNA, 1410 nt, Artificial Sequence
  derived and/or modified sequence opt1 from neuraminidase__InfluenzaA__AHL96955
augaaccccaaccagaagaucaucaccaucggcagcgugucccugaccaucagcacgaucugcuucuucaugcagaucgccauccucaucaccaccgucacccugcacuucaagcaguacgaguucaacuccccgagcaacaaccaggugaugcugugcgagcccacgaucaucgagcgcaacaucaccgagaucguguaccucaccaacaccacgaucgagaaggagaucugccccaagcccgccgaguaccggaacugguccaagccgcagugcgggaucaccggcuucgcgcccuucagcaaggacaacuccauccgccugagcgccgggggcaacaucugggucacccgggagcccuacguguccugcgaccccgacaagugcuaccaguucgcccuggggcagggcaccacgcucaacaacgugcacagcaacaacaccguccgcgaccggaccccguaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguaccccgggguccgcugcgugugccgggacaacuggaagggcuccaaccgcccgaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggccggacggggccgaccugaaccugaugcccaucuga

SEQ ID NO: 85834 - RNA, 1410 nt, Artificial Sequence; identical to SEQ ID NO: 85732
  derived and/or modified sequence opt1 from neuraminidase__InfluenzaA__AHL96967

SEQ ID NO: 85835 - RNA, 1410 nt, Artificial Sequence
  derived and/or modified sequence opt1 from neuraminidase__InfluenzaA__AHL96979
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaacaucaugcccaucuga

SEQ ID NO: 85836 - RNA, 1410 nt, Artificial Sequence; identical to SEQ ID NO: 84891
  derived and/or modified sequence opt1 from neuraminidase__InfluenzaA__AHL96991

SEQ ID NO: 85837 - RNA, 1410 nt, Artificial Sequence; identical to SEQ ID NO: 83154
  derived and/or modified sequence opt1 from neuraminidase__InfluenzaA__AHL97003

SEQ ID NO: 85838 - RNA, 1410 nt, Artificial Sequence
  derived and/or modified sequence opt1 from neuraminidase__InfluenzaA__AHL97015
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccagaucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85839 - RNA, 1410 nt, Artificial Sequence; identical to SEQ ID NO: 83154
  derived and/or modified sequence opt1 from neuraminidase__InfluenzaA__AHL97027

SEQ ID NO: 85840 - RNA, 1410 nt, Artificial Sequence
  derived and/or modified sequence opt1 from neuraminidase__InfluenzaA__AHL97039
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcaacgccuccggcaaggccgacaccaagauccuguucaucgaggaggggaagaucgugcacacgagcacccucagcggcuccgcgcagcacguggaggagugcagcugcuacccccgguacccggggguccgcugcgugugccgggacaacuggaagggcuccaaccgccccaucguggacaucaacaucaaggacuacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85841 - RNA, 1410 nt, Artificial Sequence; identical to SEQ ID NO: 83154
  derived and/or modified sequence opt1 from neuraminidase__InfluenzaA__AHL97051

SEQ ID NO: 85842 - RNA, 1410 nt, Artificial Sequence
  derived and/or modified sequence opt1 from neuraminidase__InfluenzaA__AHL97063
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccugggccccaacaacgaggagggcgggcacggggucaagggcugggccuucgacgacggcaacgacguguggauggggcgcaccaucaacgagacgagccggcucggcuacgagaccuucaaggucaucgacgggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85843 - RNA, 1410 nt, Artificial Sequence; identical to SEQ ID NO: 83154
  derived and/or modified sequence opt1 from neuraminidase__InfluenzaA__AHL97075

SEQ ID NO: 85844 - RNA, 1410 nt, Artificial Sequence; identical to SEQ ID NO: 84879
  derived and/or modified sequence opt1 from neuraminidase__InfluenzaA__AHL97087

SEQ ID NO: 85845 - RNA, 1410 nt, Artificial Sequence; identical to SEQ ID NO: 84383
  derived and/or modified sequence opt1 from neuraminidase__InfluenzaA__AHL97099

SEQ ID NO: 85846 - RNA, 1410 nt, Artificial Sequence; identical to SEQ ID NO: 83154
  derived and/or modified sequence opt1 from neuraminidase__InfluenzaA__AHL97111

SEQ ID NO: 85847 - RNA, 1410 nt, Artificial Sequence
  derived and/or modified sequence opt1 from neuraminidase__InfluenzaA__AHL97123
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggcgcaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85848 - RNA, 1410 nt, Artificial Sequence; identical to SEQ ID NO: 84911
  derived and/or modified sequence opt1 from neuraminidase__InfluenzaA__AHL97135

SEQ ID NO: 85849 - RNA, 1410 nt, Artificial Sequence
  derived and/or modified sequence opt1 from neuraminidase__InfluenzaA__AHL97147
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggcgcggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85850 - RNA, 1410 nt, Artificial Sequence; identical to SEQ ID NO: 83154
  derived and/or modified sequence opt1 from neuraminidase__InfluenzaA__AHL97159

SEQ ID NO: 85851 - RNA, 1410 nt, Artificial Sequence; identical to SEQ ID NO: 83154
  derived and/or modified sequence opt1 from neuraminidase__InfluenzaA__AHL97171

SEQ ID NO: 85852 - RNA, 1410 nt, Artificial Sequence; identical to SEQ ID NO: 83154
  derived and/or modified sequence opt1 from neuraminidase__InfluenzaA__AHL97183

SEQ ID NO: 85853 - RNA, 1410 nt, Artificial Sequence; identical to SEQ ID NO: 83154
  derived and/or modified sequence opt1 from neuraminidase__InfluenzaA__AHL97195

SEQ ID NO: 85854 - RNA, 1410 nt, Artificial Sequence; identical to SEQ ID NO: 83154
  derived and/or modified sequence opt1 from neuraminidase__InfluenzaA__AHL97207

SEQ ID NO: 85855 - RNA, 1410 nt, Artificial Sequence; identical to SEQ ID NO: 83154
  derived and/or modified sequence opt1 from neuraminidase__InfluenzaA__AHL97219

SEQ ID NO: 85856 - RNA, 1410 nt, Artificial Sequence
  derived and/or modified sequence opt1 from neuraminidase__InfluenzaA__AHL97231
augaaccccaaccagaagaucaucaccaucggcagcgugucccugaccaucagcacgaucugcuucuucaugcagaucgccauccucaucaccaccgucacccugcacuucaagcaguacgacuucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccgucaucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucggcgggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85857 - RNA, 1410 nt, Artificial Sequence
  derived and/or modified sequence opt1 from neuraminidase__InfluenzaA__AHL97243
augaaccccaaccagaagaucaucaccaucggcagcgugucccugaccaucagcacgaucugcuucuucaugcagaucgccauccucaucaccaccgucacccugaacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85858 - RNA, 1410 nt, Artificial Sequence; identical to SEQ ID NO: 84383
  derived and/or modified sequence opt1 from neuraminidase__InfluenzaA__AHL97255

SEQ ID NO: 85859 - RNA, 1410 nt, Artificial Sequence
  derived and/or modified sequence opt1 from neuraminidase__InfluenzaA__AHL97267
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacacgccccggaagaacgacuccuucagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggucaucguggaccgcggggaccggagcggcuacuccgggaucuucagcguggagggcaaguccugcaucaaccggugcuucuacgucgagcugauccgcggccggaaggaggagaccgaggugcucuggaccagcaacagcaucguggucuucugcgggacguccggcaccuacgggaccggcagcuggcccgacggggccgaccugaaccugaugcccaucuga

SEQ ID NO: 85860 - RNA, 1410 nt, Artificial Sequence; identical to SEQ ID NO: 83154
  derived and/or modified sequence opt1 from neuraminidase__InfluenzaA__AHL97279

SEQ ID NO: 85861 - RNA, 1410 nt, Artificial Sequence; identical to SEQ ID NO: 85744
  derived and/or modified sequence opt1 from neuraminidase__InfluenzaA__AHL97291

SEQ ID NO: 85862 - RNA, 1410 nt, Artificial Sequence; identical to SEQ ID NO: 85732
  derived and/or modified sequence opt1 from neuraminidase__InfluenzaA__AHL97303

SEQ ID NO: 85863 - RNA, 1410 nt, Artificial Sequence
  derived and/or modified sequence opt1 from neuraminidase__InfluenzaA__AHL97339
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggaccagcuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggccgggccgacaccaagauccuguucaucgaggaggggaagaucgugcacacguccacccucagcggcuccgcgcagcacguggaggagugcagcugcuacccccgcuaccccgggguccggugcgugugccgcgacaacuggaagggcuccaaccggccgaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaaccccaaguccaagcugcagaucaaccggcaggucaucguggaccgcggggaccggagcggcuacuccgggaucuucagcguggagggcaagagcugcaucaaccgcugcuucuacguggagcugauccggggccgcaaggaggagaccgaggugcucuggaccuccaacagcaucgucguguucugcgggacguccggcaccuacgggaccggcagcuggccggacggggccgaccugaaccugaugcccaucuga

SEQ ID NO: 85864 - RNA, 1410 nt, Artificial Sequence; identical to SEQ ID NO: 84879
  derived and/or modified sequence opt1 from neuraminidase__InfluenzaA__AHL97351

SEQ ID NO: 85865 - RNA, 1410 nt, Artificial Sequence; identical to SEQ ID NO: 85744
  derived and/or modified sequence opt1 from neuraminidase__InfluenzaA__AHL97363

SEQ ID NO: 85866 - RNA, 1410 nt, Artificial Sequence; identical to SEQ ID NO: 83154
  derived and/or modified sequence opt1 from neuraminidase__InfluenzaA__AHL97387

SEQ ID NO: 85867 - RNA, 1410 nt, Artificial Sequence
  derived and/or modified sequence opt1 from neuraminidase__InfluenzaA__AHL97399
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgacccggacaagugcuaccaguucgcccuggggcagggcaccacgcucaacaacaugcacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucgucgaccgcggggaccgguccggcuacagcgggaucuucuccguggagggccggagcugcaucaaccgcugcuucuacguggagcugauccggggccgcaaggaggagaccgagguccucuggaccagcaacuccaucgugguguucugcgggacgagcggcaccuacgggaccggcuccuggcccgacggggccgaccugaaccugaugcccaucuga

SEQ ID NO: 85868 - RNA, 1410 nt, Artificial Sequence; identical to SEQ ID NO: 84383
  derived and/or modified sequence opt1 from neuraminidase__InfluenzaA__AHL97411

SEQ ID NO: 85869 - RNA, 1410 nt, Artificial Sequence
  derived and/or modified sequence opt1 from neuraminidase__InfluenzaA__AHL97423
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacauguggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85870 - RNA, 1410 nt, Artificial Sequence
  derived and/or modified sequence opt1 from neuraminidase__InfluenzaA__AHL97447
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccuucagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85871 - RNA, 1410 nt, Artificial Sequence; identical to SEQ ID NO: 83154
  derived and/or modified sequence opt1 from neuraminidase__InfluenzaA__AHL97459

SEQ ID NO: 85872 - RNA, 1410 nt, Artificial Sequence; identical to SEQ ID NO: 85744
  derived and/or modified sequence opt1 from neuraminidase__InfluenzaA__AHL97471

SEQ ID NO: 85873 - RNA, 1410 nt, Artificial Sequence; identical to SEQ ID NO: 84879
  derived and/or modified sequence opt1 from neuraminidase__InfluenzaA__AHL97483

SEQ ID NO: 85874 - RNA, 1410 nt, Artificial Sequence; identical to SEQ ID NO: 83154
  derived and/or modified sequence opt1 from neuraminidase__InfluenzaA__AHL97496

SEQ ID NO: 85875 - RNA, 1410 nt, Artificial Sequence; identical to SEQ ID NO: 83154
  derived and/or modified sequence opt1 from neuraminidase__InfluenzaA__AHL97508

SEQ ID NO: 85876 - RNA, 1410 nt, Artificial Sequence
  derived and/or modified sequence opt1 from neuraminidase__InfluenzaA__AHL97520
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgggccggacaagugcuaccaguucgcccugggccagggcacgacccucaacaacaugcacuccaacaacaccgugcgcgaccggacccccuaccgcacgcugcugaugaacgagcucgggguccccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacgcaggagagcgagugcgucugcaucaacgggaccugcaccguggugaugaccgacggcuccgccagcgggaaggccgacacgaagauccuguucaucgaggagggcaagaucguccacaccagcacccucuccgggagcgcgcagcacguggaggagugcuccugcuacccccgguacccgggcgugcgcugcgucugccgggacaacuggaagggcagcaaccgccccaucguggacaucaacaucaaggaccacuccaucgugagcuccuacgucugcagcgggcuggugggcgacaccccgcggaagaacgacuccagcuccagcucccacugccuggaccccaacaacgaggagggcggccacggggugaagggcugggccuucgacgacggcaacgacgucuggauggggcgcacgaucaacgagaccagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggacgagcaacuccaucguggucuucugcggcaccagcgggaccuacggcaccggguccuggcccgacggcgccgaccugaaccugaugcccaucuga

SEQ ID NO: 85877 - RNA, 1410 nt, Artificial Sequence; identical to SEQ ID NO: 83154
  derived and/or modified sequence opt1 from neuraminidase__InfluenzaA__AHL97532

SEQ ID NO: 85878 - RNA, 1410 nt, Artificial Sequence; identical to SEQ ID NO: 83154
  derived and/or modified sequence opt1 from neuraminidase__InfluenzaA__AHL97544

SEQ ID NO: 85879 - RNA, 1410 nt, Artificial Sequence; identical to SEQ ID NO: 84879
  derived and/or modified sequence opt1 from neuraminidase__InfluenzaA__AHL97556

SEQ ID NO: 85880 - RNA, 1410 nt, Artificial Sequence
  derived and/or modified sequence opt1 from neuraminidase__InfluenzaA__AHL97568
augaaccccaaccagaagaucaucaccaucggcagcgugucccugaccaucagcgccaucugcuucuucaugcagaucgccauccucaucacgaccgucacccugcgcuucaagcaguacgaguucaacuccccgcccaacaaccaggugaugcugugcgagcccaccaucaucgagcggaacaucacggagaucguguaccucaccaacaccaccaucgagaaggagaucugccccaagccggcggaguaccgcaacuggagcaagccccagugcgacaucacgggguucgcccccuucuccaaggacaacagcauccggcuguccgccggcggggacaucugggucacccgcgagcccuacgugagcugcgacccggacaagugcuaccaguucgcccugggccaggggaccacccucacgaacgugcacuccaacaacaccguccgggaccgcacccccuaccggacccugcugaugaacgagcucggcgugcccuuccaccugggcacgaagcaggucugcaucgccuggagcuccagcuccugccacgacgggaaggcguggcugcacgugugcaucaccggcgacgacaagaacgccaccgccagcuucaucuacaacgggcgccucguggacuccguggucagcugguccaaggagauccugcggacccaggagagcgagugcgugugcaucaacggcacgugcaccguggucaugaccgacggguccgccagcggcaaggcggacaccaagauccuguucaucgaggagggcaagaucgugcacacgagcacccucuccgggagcgcccagcacguggaggagugcuccugcuacccccgcuacccgggcguccggugcgugugccgcgacaacuggaaggggagcaaccggcccaucguggacaucaacaucaaggaccacuccaucgucagccgcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgaggggaaguccugcaucaaccggugcuucuacguggagcugauccgcggccgcaaggaggagaccgaggugcucuggaccagcaacagcaucgucguguucugcggcacguccgggaccuacggcaccgggagcuggcccgacggcgccgaccugaaccugaugcccaucuga

SEQ ID NO: 85881 - RNA, 1410 nt, Artificial Sequence; identical to SEQ ID NO: 85794
  derived and/or modified sequence opt1 from neuraminidase__InfluenzaA__AHL97580

SEQ ID NO: 85882 - RNA, 1410 nt, Artificial Sequence
  derived and/or modified sequence opt1 from neuraminidase__InfluenzaA__AHL97592
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcguccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacacgccccggaagaacgacuccagcuccagcucccacugccugggccccaacaacgaggagggcgggcacggggugaagggcugggccuucgacgacggcaacgacgucuggauggggcgcaccaucaacgagaccagccgguccggcuacgagaccuucaaggugaucgagggguggagcaacccgaaguccaagcuccagaucaaccgccaggugaucgucgaccggggcgaccgcagcggguacuccggcaucuucagcguggagggcaagagcugcaucaaccggugcuucuacguggagcugauccgcgggcggaaggaggagaccgagguccuguggaccuccaacagcaucgugguguucugcggcacguccgggaccuacggcaccgggagcuggcccgacggcgccgaccucaaccugaugcccaucuga

SEQ ID NO: 85883 - RNA, 1410 nt, Artificial Sequence; identical to SEQ ID NO: 83154
  derived and/or modified sequence opt1 from neuraminidase__InfluenzaA__AHL97604

SEQ ID NO: 85884 - RNA, 1410 nt, Artificial Sequence
  derived and/or modified sequence opt1 from neuraminidase__InfluenzaA__AHL97616
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagguccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85885 - RNA, 1410 nt, Artificial Sequence; identical to SEQ ID NO: 85744
  derived and/or modified sequence opt1 from neuraminidase__InfluenzaA__AHL97628

SEQ ID NO: 85886 - RNA, 1410 nt, Artificial Sequence; identical to SEQ ID NO: 83154
  derived and/or modified sequence opt1 from neuraminidase__InfluenzaA__AHL97640

SEQ ID NO: 85887 - RNA, 1410 nt, Artificial Sequence; identical to SEQ ID NO: 84902
  derived and/or modified sequence opt1 from neuraminidase__InfluenzaA__AHL97652

SEQ ID NO: 85888 - RNA, 1410 nt, Artificial Sequence; identical to SEQ ID NO: 84902
  derived and/or modified sequence opt1 from neuraminidase__InfluenzaA__AHL97664

SEQ ID NO: 85889 - RNA, 1410 nt, Artificial Sequence; identical to SEQ ID NO: 84383
  derived and/or modified sequence opt1 from neuraminidase__InfluenzaA__AHL97676

SEQ ID NO: 85890 - RNA, 1410 nt, Artificial Sequence; identical to SEQ ID NO: 83154
  derived and/or modified sequence opt1 from neuraminidase__InfluenzaA__AHL97688

SEQ ID NO: 85891 - RNA, 1410 nt, Artificial Sequence; identical to SEQ ID NO: 84879
  derived and/or modified sequence opt1 from neuraminidase__InfluenzaA__AHL97700

SEQ ID NO: 85892 - RNA, 1410 nt, Artificial Sequence
  derived and/or modified sequence opt1 from neuraminidase__InfluenzaA__AHL97712
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccaccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggacgagcaacagcaucgucguguucugcgggaccuccggcaccuacgggaccggcagcuggcccgacggggccgaccugaaccugaugcccaucuga

SEQ ID NO: 85893 - RNA, 1410 nt, Artificial Sequence; identical to SEQ ID NO: 84879
  derived and/or modified sequence opt1 from neuraminidase__InfluenzaA__AHL97724

SEQ ID NO: 85894 - RNA, 1410 nt, Artificial Sequence; identical to SEQ ID NO: 83154
  derived and/or modified sequence opt1 from neuraminidase__InfluenzaA__AHL97736

SEQ ID NO: 85895 - RNA, 1410 nt, Artificial Sequence
  derived and/or modified sequence opt1 from neuraminidase__InfluenzaA__AHL97760
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacgagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85896 - RNA, 1410 nt, Artificial Sequence
  derived and/or modified sequence opt1 from neuraminidase__InfluenzaA__AHL97772
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccgucgugguguucugcgggacgagcggcaccuacgggaccggcuccuggcccgacggggccgaccugaaccugaugcccaucuga

SEQ ID NO: 85897 - RNA, 1410 nt, Artificial Sequence; identical to SEQ ID NO: 84383
  derived and/or modified sequence opt1 from neuraminidase__InfluenzaA__AHL97784

SEQ ID NO: 85898 - RNA, 1410 nt, Artificial Sequence; identical to SEQ ID NO: 83154
  derived and/or modified sequence opt1 from neuraminidase__InfluenzaA__AHL97796

SEQ ID NO: 85899 - RNA, 1410 nt, Artificial Sequence; identical to SEQ ID NO: 83154
  derived and/or modified sequence opt1 from neuraminidase__InfluenzaA__AHL97808

SEQ ID NO: 85900 - RNA, 1410 nt, Artificial Sequence; identical to SEQ ID NO: 83154
  derived and/or modified sequence opt1 from neuraminidase__InfluenzaA__AHL97820

SEQ ID NO: 85901 - RNA, 1410 nt, Artificial Sequence
  derived and/or modified sequence opt1 from neuraminidase__InfluenzaA__AHL97832
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggagcugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggcccgacggggccgaccugaaccugaugcccaucuga

SEQ ID NO: 85902 - RNA, 1410 nt, Artificial Sequence; identical to SEQ ID NO: 83154
  derived and/or modified sequence opt1 from neuraminidase__InfluenzaA__AHL97844

SEQ ID NO: 85903 - RNA, 1410 nt, Artificial Sequence; identical to SEQ ID NO: 85895
  derived and/or modified sequence opt1 from neuraminidase__InfluenzaA__AHL97856

SEQ ID NO: 85904 - RNA, 1410 nt, Artificial Sequence; identical to SEQ ID NO: 83154
  derived and/or modified sequence opt1 from neuraminidase__InfluenzaA__AHL97868

SEQ ID NO: 85905 - RNA, 1410 nt, Artificial Sequence; identical to SEQ ID NO: 84879
  derived and/or modified sequence opt1 from neuraminidase__InfluenzaA__AHL97880

SEQ ID NO: 85906 - RNA, 1410 nt, Artificial Sequence; identical to SEQ ID NO: 83154
  derived and/or modified sequence opt1 from neuraminidase__InfluenzaA__AHL97892

SEQ ID NO: 85907 - RNA, 1410 nt, Artificial Sequence; identical to SEQ ID NO: 83154
  derived and/or modified sequence opt1 from neuraminidase__InfluenzaA__AHL97904

SEQ ID NO: 85908 - RNA, 1410 nt, Artificial Sequence; identical to SEQ ID NO: 84891
  derived and/or modified sequence opt1 from neuraminidase__InfluenzaA__AHL97916

SEQ ID NO: 85909 - RNA, 1410 nt, Artificial Sequence; identical to SEQ ID NO: 83154
  derived and/or modified sequence opt1 from neuraminidase__InfluenzaA__AHL97928

SEQ ID NO: 85910 - RNA, 1410 nt, Artificial Sequence; identical to SEQ ID NO: 85870
  derived and/or modified sequence opt1 from neuraminidase__InfluenzaA__AHL97952

SEQ ID NO: 85911 - RNA, 1410 nt, Artificial Sequence; identical to SEQ ID NO: 83154
  derived and/or modified sequence opt1 from neuraminidase__InfluenzaA__AHL97964

SEQ ID NO: 85912 - RNA, 1410 nt, Artificial Sequence; identical to SEQ ID NO: 83154
  derived and/or modified sequence opt1 from neuraminidase__InfluenzaA__AHL97976

SEQ ID NO: 85913 - RNA, 1410 nt, Artificial Sequence; identical to SEQ ID NO: 83154
  derived and/or modified sequence opt1 from neuraminidase__InfluenzaA__AHL97988

SEQ ID NO: 85914 - RNA, 1410 nt, Artificial Sequence
  derived and/or modified sequence opt1 from neuraminidase__InfluenzaA__AHL98000
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccacgagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaaggacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85915 - RNA, 1410 nt, Artificial Sequence
  derived and/or modified sequence opt1 from neuraminidase__InfluenzaA__AHL98012
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggaggugcugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgaccacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 85916 - RNA, 1410 nt, Artificial Sequence; identical to SEQ ID NO: 84891
  derived and/or modified sequence opt1 from neuraminidase__InfluenzaA__AHL98048

SEQ ID NO: 85917 - RNA, 1410 nt, Artificial Sequence; identical to SEQ ID NO: 84891
  derived and/or modified sequence opt1 from neuraminidase__InfluenzaA__AHL98060

SEQ ID NO: 85918 - RNA, 1410 nt, Artificial Sequence; identical to SEQ ID NO: 84891
  derived and/or modified sequence opt1 from neuraminidase__InfluenzaA__AHL98072

SEQ ID NO: 85919 - RNA, 1410 nt, Artificial Sequence; identical to SEQ ID NO: 83154
  derived and/or modified sequence opt1 from neuraminidase__InfluenzaA__AHL98084

SEQ ID NO: 85920 - RNA, 1410 nt, Artificial Sequence; identical to SEQ ID NO: 84891
  derived and/or modified sequence opt1 from neuraminidase__InfluenzaA__AHL98096

SEQ ID NO: 85921 - RNA, 1410 nt, Artificial Sequence; identical to SEQ ID NO: 83154
  derived and/or modified sequence opt1 from neuraminidase__InfluenzaA__AHL98119

SEQ ID NO: 85922 - RNA, 1410 nt, Artificial Sequence; identical to SEQ ID NO: 83154
  derived and/or modified sequence opt1 from neuraminidase__InfluenzaA__AHL98131

SEQ ID NO: 85923 - RNA, 1410 nt, Artificial Sequence; identical to SEQ ID NO: 83154
  derived and/or modified sequence opt1 from neuraminidase__InfluenzaA__AHL98143

SEQ ID NO: 85924 - RNA, 1410 nt, Artificial Sequence
  derived and/or modified sequence opt1 from neuraminidase__InfluenzaA__AHL98155
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaacagcaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggccggacggggccgaccugaaccugaugcccaucuga

SEQ ID NO: 85925 - RNA, 1410 nt, Artificial Sequence; identical to SEQ ID NO: 83154
  derived and/or modified sequence opt1 from neuraminidase__InfluenzaA__AHL98167

SEQ ID NO: 85926 - RNA, 1410 nt, Artificial Sequence; identical to SEQ ID NO: 83154
  derived and/or modified sequence opt1 from neuraminidase__InfluenzaA__AHL98179

SEQ ID NO: 85927 - RNA, 1410 nt, Artificial Sequence; identical to SEQ ID NO: 83154
  derived and/or modified sequence opt1 from neuraminidase__InfluenzaA__AHL98191

SEQ ID NO: 85928 - RNA, 1410 nt, Artificial Sequence; identical to SEQ ID NO: 84891
  derived and/or modified sequence opt1 from neuraminidase__InfluenzaA__AHL98215

SEQ ID NO: 85929 - RNA, 1410 nt, Artificial Sequence
  derived and/or modified sequence opt1 from neuraminidase__InfluenzaA__AHL98227
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgacaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85930 - RNA, 1410 nt, Artificial Sequence; identical to SEQ ID NO: 83154
  derived and/or modified sequence opt1 from neuraminidase__InfluenzaA__AHL98239

SEQ ID NO: 85931 - RNA, 1410 nt, Artificial Sequence; identical to SEQ ID NO: 83154
  derived and/or modified sequence opt1 from neuraminidase__InfluenzaA__AHL98251

SEQ ID NO: 85932 - RNA, 1410 nt, Artificial Sequence; identical to SEQ ID NO: 84902
  derived and/or modified sequence opt1 from neuraminidase__InfluenzaA__AHL98263

SEQ ID NO: 85933 - RNA, 1410 nt, Artificial Sequence; identical to SEQ ID NO: 83154
  derived and/or modified sequence opt1 from neuraminidase__InfluenzaA__AHL98275

SEQ ID NO: 85934 - RNA, 1410 nt, Artificial Sequence; identical to SEQ ID NO: 85800
  derived and/or modified sequence opt1 from neuraminidase__InfluenzaA__AHL98287

SEQ ID NO: 85935 - RNA, 1410 nt, Artificial Sequence
  derived and/or modified sequence opt1 from neuraminidase__InfluenzaA__AHL98298
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgggcgcaacaucaccgagaucguguaccucaccaacaccacgaucgagaaggagaucugccccaagccggccgaguaccggaacuggagcaagccccagugcggcaucaccggguucgcgcccuucuccaaggacaacagcauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggcuccgccagcgggaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaagggcagcaaccgccccaucguggacaucaacaucaaggaccacuccaucgucagcuccuacgugugcagcgggcuggugggcgacaccccgcggaagaacgacuccagcuccagcucccacugccuggaccccaacaacgaggagggcgggcacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85936 - RNA, 1410 nt, Artificial Sequence; identical to SEQ ID NO: 83154
  derived and/or modified sequence opt1 from neuraminidase__InfluenzaA__AHL98310

SEQ ID NO: 85937 - RNA, 1410 nt, Artificial Sequence; identical to SEQ ID NO: 83154
  derived and/or modified sequence opt1 from neuraminidase__InfluenzaA__AHL98322

SEQ ID NO: 85938 - RNA, 1410 nt, Artificial Sequence
  derived and/or modified sequence opt1 from neuraminidase__InfluenzaA__AHL98334
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 85939 - RNA, 1410 nt, Artificial Sequence
  derived and/or modified sequence opt1 from neuraminidase__InfluenzaA__AHL98346
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaacgaggugcucuggaccagcaacuccaucgucguguucugcgggaccagcggcacguacgggaccggcuccuggcccgacggggccgaccugaaccugaugcccaucuga

SEQ ID NO: 85940 - RNA, 1410 nt, Artificial Sequence; identical to SEQ ID NO: 83154
  derived and/or modified sequence opt1 from neuraminidase__InfluenzaA__AHL98357

SEQ ID NO: 85941 - RNA, 1410 nt, Artificial Sequence; identical to SEQ ID NO: 84902
  derived and/or modified sequence opt1 from neuraminidase__InfluenzaA__AHL98369

SEQ ID NO: 85942 - RNA, 1410 nt, Artificial Sequence
  derived and/or modified sequence opt1 from neuraminidase__InfluenzaA__AHL98381
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgggccggacaagugcuaccaguucgcccugggccagggcaccacgcucaacaacaugcacuccaacaacaccgugcgcgaccggacccccuaccgcacccugcugaugagcgagcucgggguccccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcgugguguccuggagcaaggagauccugcgcacccaggaguccgagugcgucugcaucaacggcacgugcaccguggugaugaccgacggcagcgccagcgggaaggccgacaccaagauccuguucaucgaggagggcaagaucguccacacguccacccucagcggguccgcgcagcacguggaggagugcagcugcuacccccgguacccgggcgugcgcugcgucugccgggacaacuggaagggcuccaaccgccccaucguggacaucaacaucaaggaccacagcaccguguccagcuacgucugcuccgggcuggugggcgacacgccccggaagaacgacagcuccagcuccagccacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggagcaacccgaaguccaagcugcagaucaaccgccaggucaucguggaccggggcgaccgcagcggguacuccggcaucuucagcguggagggcaagagcugcaucaaccggugcuucuacgucgagcugauccgcgggcggaaggaggagaccgaggugcucuggacguccaacagcaucguggucuucugcggcaccuccgggaccuacggcaccgggagcuggcccgacggcgccgaccugaaccugaugcccaucuga

SEQ ID NO: 85943 - RNA, 1410 nt, Artificial Sequence
  derived and/or modified sequence opt1 from neuraminidase__InfluenzaA__AHL98393
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgggccggacaagugcuaccaguucgcccugggccagggcaccacgcucaacaacaugcacuccaacaacaccgugcgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggcuccgccagcgggaaggccgacaccaagauccuguucaucgaggagggcaagaucgugcacacgagcacccucuccgggagcgaccagcacaucgaggagugcuccugcuacccccgguacccgggcguccgcugcgugugccgggacaacuggaagggcagcaaccgccccaucguggacaucaacaucaaggaccacuccaucgucagcuccuacgugugcagcgggcuggugggcgacaccccgcggaagaacgacuccagcuccagcucccacugccuggaccccaacaacgaggagggcgggcacggggucaagggcugggcguucgacgacggcaacgacguguggauggggcgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85944 - RNA, 1410 nt, Artificial Sequence; identical to SEQ ID NO: 83154
  derived and/or modified sequence opt1 from neuraminidase__InfluenzaA__AHL98405

SEQ ID NO: 85945 - RNA, 1410 nt, Artificial Sequence; identical to SEQ ID NO: 83154
  derived and/or modified sequence opt1 from neuraminidase__InfluenzaA__AHL98417

SEQ ID NO: 85946 - RNA, 1410 nt, Artificial Sequence; identical to SEQ ID NO: 83154
  derived and/or modified sequence opt1 from neuraminidase__InfluenzaA__AHL98429

SEQ ID NO: 85947 - RNA, 1410 nt, Artificial Sequence
  derived and/or modified sequence opt1 from neuraminidase__InfluenzaA__AHL98452
augaaccccacccagaagaucaucaccaucggcagcgugugcaugacgaucgggauggccaaccugauccuccagaucggcaacaucaucuccaucuggaucagccacuccauccagcuggggaaccagagccagaucgagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacacgaucaagagcuggaagaacaacauccugcgcacccaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcacggacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 85948 - RNA, 1410 nt, Artificial Sequence
  derived and/or modified sequence opt1 from neuraminidase__InfluenzaA__AHL98474
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccaacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 85949 - RNA, 1410 nt, Artificial Sequence
  derived and/or modified sequence opt1 from neuraminidase__InfluenzaA__AHL98485
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcauccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 85950 - RNA, 1410 nt, Artificial Sequence; identical to SEQ ID NO: 84383
  derived and/or modified sequence opt1 from neuraminidase__InfluenzaA__AHL98497

SEQ ID NO: 85951 - RNA, 1410 nt, Artificial Sequence; identical to SEQ ID NO: 83154
  derived and/or modified sequence opt1 from neuraminidase__InfluenzaA__AHL98509

SEQ ID NO: 85952 - RNA, 1410 nt, Artificial Sequence; identical to SEQ ID NO: 83154
  derived and/or modified sequence opt1 from neuraminidase__InfluenzaA__AHL98521

SEQ ID NO: 85953 - RNA, 1410 nt, Artificial Sequence; identical to SEQ ID NO: 84383
  derived and/or modified sequence opt1 from neuraminidase__InfluenzaA__AHL98533

SEQ ID NO: 85954 - RNA, 1410 nt, Artificial Sequence; identical to SEQ ID NO: 83154
  derived and/or modified sequence opt1 from neuraminidase__InfluenzaA__AHL98545

SEQ ID NO: 85955 - RNA, 1410 nt, Artificial Sequence; identical to SEQ ID NO: 83154
  derived and/or modified sequence opt1 from neuraminidase__InfluenzaA__AHL98557

SEQ ID NO: 85956 - RNA, 1410 nt, Artificial Sequence; identical to SEQ ID NO: 83154
  derived and/or modified sequence opt1 from neuraminidase__InfluenzaA__AHL98569

SEQ ID NO: 85957 - RNA, 1410 nt, Artificial Sequence
  derived and/or modified sequence opt1 from neuraminidase__InfluenzaA__AHL98581
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcaacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85958 - RNA, 1410 nt, Artificial Sequence; identical to SEQ ID NO: 83154
  derived and/or modified sequence opt1 from neuraminidase__InfluenzaA__AHL98593

SEQ ID NO: 85959 - RNA, 1410 nt, Artificial Sequence; identical to SEQ ID NO: 84891
  derived and/or modified sequence opt1 from neuraminidase__InfluenzaA__AHL98605

SEQ ID NO: 85960 - RNA, 1410 nt, Artificial Sequence; identical to SEQ ID NO: 84383
  derived and/or modified sequence opt1 from neuraminidase__InfluenzaA__AHL98617

SEQ ID NO: 85961 - RNA, 1410 nt, Artificial Sequence; identical to SEQ ID NO: 84383
  derived and/or modified sequence opt1 from neuraminidase__InfluenzaA__AHL98629

SEQ ID NO: 85962 - RNA, 1410 nt, Artificial Sequence; identical to SEQ ID NO: 83154
  derived and/or modified sequence opt1 from neuraminidase__InfluenzaA__AHL98641

SEQ ID NO: 85963 - RNA, 1410 nt, Artificial Sequence; identical to SEQ ID NO: 85732
  derived and/or modified sequence opt1 from neuraminidase__InfluenzaA__AHL98653

SEQ ID NO: 85964 - RNA, 1410 nt, Artificial Sequence; identical to SEQ ID NO: 83154
  derived and/or modified sequence opt1 from neuraminidase__InfluenzaA__AHL98665

SEQ ID NO: 85965 - RNA, 1410 nt, Artificial Sequence
  derived and/or modified sequence opt1 from neuraminidase__InfluenzaA__AHL98677
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacgccccaccgcacccugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcaacgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85966 - RNA, 1410 nt, Artificial Sequence; identical to SEQ ID NO: 84902
  derived and/or modified sequence opt1 from neuraminidase__InfluenzaA__AHL98689

SEQ ID NO: 85967 - RNA, 1410 nt, Artificial Sequence
  derived and/or modified sequence opt1 from neuraminidase__InfluenzaA__AHL98702
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacggccacuccaacaacaccgugcgcgaccggacccccuaccgcacccugcugaugaacgagcucgggguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggcuccgccagcgggaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaagggcagcaaccgccccaucguggacaucaacaucaaggaccacuccaucgugagcuccuacgucugcagcgggcuggugggcgacaccccgcggaagaacgacuccagcuccagcucccacugccuggaccccaacaacgaggagggcgggcacggggugaagggcugggccuucgacgacggcaacgacgucuggauggggcgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 85968 - RNA, 1410 nt, Artificial Sequence; identical to SEQ ID NO: 84397
  derived and/or modified sequence opt1 from neuraminidase__InfluenzaA__AHL98714

SEQ ID NO: 85969 - RNA, 1410 nt, Artificial Sequence
  derived and/or modified sequence opt1 from neuraminidase__InfluenzaA__AHL98725
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgggaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggcaacgccuccgggaaggccgacaccaagauccuguucaucgaggagggcaagaucgugcacacgagcacccucagcggguccgcgcagcacguggaggagugcagcugcuacccccgguacccgggcguccgcugcgugugccgggacaacuggaagggcuccaaccgccccaucguggacaucaacaucaaggaccacagcaucgucuccagcuacgugugcuccgggcuggugggcgacacgccccggaagaacgacagcuccagcuccagccacugccuggaccccaacaacgaggagggcgggcacggggucaagggcugggccuucgacgacgagaacgacguguggaugggccgcaccaucaacgagaccucccggcucggguacgagaccuucaaggucaucgagggcuggagcaacccgaaguccaagcugcagaucaaccgccaggugaucguggaccgggggaaccgcagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85970 - RNA, 1410 nt, Artificial Sequence; identical to SEQ ID NO: 84891
  derived and/or modified sequence opt1 from neuraminidase__InfluenzaA__AHL98737

SEQ ID NO: 85971 - RNA, 1410 nt, Artificial Sequence; identical to SEQ ID NO: 84879
  derived and/or modified sequence opt1 from neuraminidase__InfluenzaA__AHL98749

SEQ ID NO: 85972 - RNA, 1410 nt, Artificial Sequence; identical to SEQ ID NO: 84891
  derived and/or modified sequence opt1 from neuraminidase__InfluenzaA__AHL98761

SEQ ID NO: 85973 - RNA, 1410 nt, Artificial Sequence
  derived and/or modified sequence opt1 from neuraminidase__InfluenzaA__AHL98773
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcaacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85974 - RNA, 1410 nt, Artificial Sequence; identical to SEQ ID NO: 84911
  derived and/or modified sequence opt1 from neuraminidase__InfluenzaA__AHL98785

SEQ ID NO: 85975 - RNA, 1410 nt, Artificial Sequence
  derived and/or modified sequence opt1 from neuraminidase__InfluenzaA__AHL98797
augaaccccaaccagaagaucaucaccaucggcagcgugucccugaccaucagcacgaucugcuucuucacccagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccgguccggguacgagaccuucaaggucaucgagggcuggagcaacccgaaguccaagcuccagaucaaccgccaggugaucguggaccgcggggaccggagcggcuacuccgggaucuucagcgucgagggcaagagcugcaucaaccggugcuucuacguggagcugauccgcggccggaaggaggagaccgaggugcuguggacguccaacagcaucgucguguucugcgggaccuccggcaccuacgggaccggcagcuggcccgacggggccgaccucaaccugaugcccaucuga

SEQ ID NO: 85976 - RNA, 1410 nt, Artificial Sequence; identical to SEQ ID NO: 83154
  derived and/or modified sequence opt1 from neuraminidase__InfluenzaA__AHL98809

SEQ ID NO: 85977 - RNA, 1410 nt, Artificial Sequence
  derived and/or modified sequence opt1 from neuraminidase__InfluenzaA__AHL98821
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggugagcugguccaaggagauccugcggacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgcuacccgggggugcggugcgucugccgcgacaacuggaagggcagcaaccggcccaucguggacaucaacaucaaggaccacuccaucgugagcuccuacgucugcagcggccuggugggggacaccccgcgcaagaacgacuccagcuccagcucccacugccuggaccccaacaacgaggagggcgggcacggcgugaaggggugggccuucgacgacggcaacgacgucuggaugggccggaccaucaacgagacgagccgccucggguacgagaccuucaaggugaucgagggcugguccaaccccaagagcaagcugcagaucaaccggcaggucaucguggaccgcggggaccgguccggcuacagcgggaucuucuccguggagggcaagagcugcaucaaccgcugcuucuacgucgagcugauccggggccgcaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85978 - RNA, 1410 nt, Artificial Sequence; identical to SEQ ID NO: 83154
  derived and/or modified sequence opt1 from neuraminidase__InfluenzaA__AHL98833

SEQ ID NO: 85979 - RNA, 1410 nt, Artificial Sequence
  derived and/or modified sequence opt1 from neuraminidase__InfluenzaA__AHL98845
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgggccggacaagugcuaccaguucgcccugggccagggcaccacccucaacaacaugcacuccaacaacacggugcgcgaccggacccccuaccgcacccugcugaugaacgagcucgggguccccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggugagcugguccaaggagauccugcgcacccaggagagcgagugcgucugcaucaacgggaccugcacgguggugaugaccgacggcuccgccagcgggaaggccgacaccaagauccuguucaucgaggagggcaagaucguccacaccagcacgcucuccgggagcgcgcagcacguggaggagugcuccugcuacccccgguacccgggcgugcgcugcgucugccgggacaacuggaagggcagcaaccgccccaucguggacaucaacaucaaggaccacuccaucgugagcuccuacgucugcagcgggcuggugggcgacaccccgcggaagaacgacuccagcuccagcucccacugccuggaccccaacaacgaggagggcggccacggggugaagggcugggccuucgacgacggcaacgacgucuggauggggcgcaccaucaacgagaccagccggcucggcuacgagacguucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcaccagcgggacguacggcaccggguccuggcccgacggcgccgaccugaaccugaugcccaucuga

SEQ ID NO: 85980 - RNA, 1410 nt, Artificial Sequence; identical to SEQ ID NO: 84891
  derived and/or modified sequence opt1 from neuraminidase__InfluenzaA__AHL98857

SEQ ID NO: 85981 - RNA, 1410 nt, Artificial Sequence; identical to SEQ ID NO: 84891
  derived and/or modified sequence opt1 from neuraminidase__InfluenzaA__AHL98869

SEQ ID NO: 85982 - RNA, 1410 nt, Artificial Sequence; identical to SEQ ID NO: 83154
  derived and/or modified sequence opt1 from neuraminidase__InfluenzaA__AHL98881

SEQ ID NO: 85983 - RNA, 1410 nt, Artificial Sequence
  derived and/or modified sequence opt1 from neuraminidase__InfluenzaA__AHL98893
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucuucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85984 - RNA, 1410 nt, Artificial Sequence; identical to SEQ ID NO: 84879
  derived and/or modified sequence opt1 from neuraminidase__InfluenzaA__AHL98905

SEQ ID NO: 85985 - RNA, 1410 nt, Artificial Sequence; identical to SEQ ID NO: 83154
  derived and/or modified sequence opt1 from neuraminidase__InfluenzaA__AHL98916

SEQ ID NO: 85986 - RNA, 1410 nt, Artificial Sequence; identical to SEQ ID NO: 84902
  derived and/or modified sequence opt1 from neuraminidase__InfluenzaA__AHL98928

SEQ ID NO: 85987 - RNA, 1410 nt, Artificial Sequence; identical to SEQ ID NO: 83154
  derived and/or modified sequence opt1 from neuraminidase__InfluenzaA__AHL98940

SEQ ID NO: 85988 - RNA, 1410 nt, Artificial Sequence; identical to SEQ ID NO: 83154
  derived and/or modified sequence opt1 from neuraminidase__InfluenzaA__AHL98952

SEQ ID NO: 85989 - RNA, 1410 nt, Artificial Sequence; identical to SEQ ID NO: 84879
  derived and/or modified sequence opt1 from neuraminidase__InfluenzaA__AHL98964

SEQ ID NO: 85990 - RNA, 1410 nt, Artificial Sequence
  derived and/or modified sequence opt1 from neuraminidase__InfluenzaA__AHL98976
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgccagcugguccaaggaggugcugcgcacccaggagagcgagugcgugugcaucaacgggacgugcgccgucgugaugaccgacggcuccgcgagcggcaaggccgacaccaagauccuguucaucgaggaggggaagaucgugcacaccagcacgcucuccggcagcgcccagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagacguucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggaccagcggcacguacgggaccggcuccuggcccgacggggccgaccugaaccugaugcccaucuga

SEQ ID NO: 85991 - RNA, 1410 nt, Artificial Sequence; identical to SEQ ID NO: 84879
  derived and/or modified sequence opt1 from neuraminidase__InfluenzaA__AHL98988

SEQ ID NO: 85992 - RNA, 1410 nt, Artificial Sequence; identical to SEQ ID NO: 83154
  derived and/or modified sequence opt1 from neuraminidase__InfluenzaA__AHL99000

SEQ ID NO: 85993 - RNA, 1410 nt, Artificial Sequence; identical to SEQ ID NO: 83154
  derived and/or modified sequence opt1 from neuraminidase__InfluenzaA__AHL99012

SEQ ID NO: 85994 - RNA, 1410 nt, Artificial Sequence
  derived and/or modified sequence opt1 from neuraminidase__InfluenzaA__AHL99024
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcaucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85995 - RNA, 1410 nt, Artificial Sequence; identical to SEQ ID NO: 84372
  derived and/or modified sequence opt1 from neuraminidase__InfluenzaA__AHL99036

SEQ ID NO: 85996 - RNA, 1410 nt, Artificial Sequence; identical to SEQ ID NO: 85794
  derived and/or modified sequence opt1 from neuraminidase__InfluenzaA__AHL99048

SEQ ID NO: 85997 - RNA, 1410 nt, Artificial Sequence; identical to SEQ ID NO: 83154
  derived and/or modified sequence opt1 from neuraminidase__InfluenzaA__AHL99060

SEQ ID NO: 85998 - RNA, 1410 nt, Artificial Sequence
  derived and/or modified sequence opt1 from neuraminidase__InfluenzaA__AHL99072
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaugaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85999 - RNA, 1410 nt, Artificial Sequence
  derived and/or modified sequence opt1 from neuraminidase__InfluenzaA__AHL99084
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggugagcugguccaaggagauccugcggacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgcuacccgggggugcggugcgucugccgcgacaacuggaagggcagcaaccggcccaucguggacaucaacaucaaggaccacaacaucguguccagcuacgucugcuccggccuggugggggacacgccccgcaagaacgacagcuccagcuccagccacugccuggaccccaacaacgaggagggcgggcacggcgugaaggggugggccuucgacgacggcaacgacgucuggaugggccggaccaucaacgagaccucccgccucggguacgagaccuucaaggugaucgagggcuggagcaacccgaaguccaagcugcagaucaaccggcaggucaucguggaccgcggggaccggagcggcuacuccgggaucuucagcguggagggcaaguccugcaucaaccgcugcuucuacgucgagcugauccggggccgcaaggaggagaccgaggugcucuggaccagcaacagcaucguggucuucugcgggacguccggcaccuacgggaccggcagcuggcccgacggggccgaccugaaccugaugcccaucuga

SEQ ID NO: 86000 - RNA, 1410 nt, Artificial Sequence; identical to SEQ ID NO: 83154
  derived and/or modified sequence opt1 from neuraminidase__InfluenzaA__AHL99096

SEQ ID NO: 86001 - RNA, 1410 nt, Artificial Sequence; identical to SEQ ID NO: 83154
  derived and/or modified sequence opt1 from neuraminidase__InfluenzaA__AHL99108

SEQ ID NO: 86002 - RNA, 1410 nt, Artificial Sequence; identical to SEQ ID NO: 83154
  derived and/or modified sequence opt1 from neuraminidase__InfluenzaA__AHL99120

SEQ ID NO: 86003 - RNA, 1410 nt, Artificial Sequence; identical to SEQ ID NO: 83154
  derived and/or modified sequence opt1 from neuraminidase__InfluenzaA__AHL99132

SEQ ID NO: 86004 - RNA, 1410 nt, Artificial Sequence
  derived and/or modified sequence opt1 from neuraminidase__InfluenzaA__AHL99144
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggcggaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86005 - RNA, 1410 nt, Artificial Sequence; identical to SEQ ID NO: 83154
  derived and/or modified sequence opt1 from neuraminidase__InfluenzaA__AHL99156

SEQ ID NO: 86006 - RNA, 1410 nt, Artificial Sequence
  derived and/or modified sequence opt1 from neuraminidase__InfluenzaA__AHL99168
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaccaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86007 - RNA, 1410 nt, Artificial Sequence; identical to SEQ ID NO: 83154
  derived and/or modified sequence opt1 from neuraminidase__InfluenzaA__AHL99180

SEQ ID NO: 86008 - RNA, 1410 nt, Artificial Sequence; identical to SEQ ID NO: 84018
  derived and/or modified sequence opt1 from neuraminidase__InfluenzaA__AHL99204

SEQ ID NO: 86009 - RNA, 1410 nt, Artificial Sequence
  derived and/or modified sequence opt1 from neuraminidase__InfluenzaA__AHL99216
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucaucgacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaagaaggagaccgaggugcucuggaccagcaacuccaucgucguguucugcgggacgagcggcaccuacgggaccggcuccuggcccgacggggccgaccugaaccugaugcccaucuga

SEQ ID NO: 86010 - RNA, 1410 nt, Artificial Sequence; identical to SEQ ID NO: 83154
  derived and/or modified sequence opt1 from neuraminidase__InfluenzaA__AHL99228

SEQ ID NO: 86011 - RNA, 1410 nt, Artificial Sequence; identical to SEQ ID NO: 83154
  derived and/or modified sequence opt1 from neuraminidase__InfluenzaA__AHL99240

SEQ ID NO: 86012 - RNA, 1410 nt, Artificial Sequence; identical to SEQ ID NO: 83154
  derived and/or modified sequence opt1 from neuraminidase__InfluenzaA__AHL99252

SEQ ID NO: 86013 - RNA, 1410 nt, Artificial Sequence; identical to SEQ ID NO: 83154
  derived and/or modified sequence opt1 from neuraminidase__InfluenzaA__AHL99264

SEQ ID NO: 86014 - RNA, 1410 nt, Artificial Sequence; identical to SEQ ID NO: 83154
  derived and/or modified sequence opt1 from neuraminidase__InfluenzaA__AHL99276

SEQ ID NO: 86015 - RNA, 1410 nt, Artificial Sequence; identical to SEQ ID NO: 84891
  derived and/or modified sequence opt1 from neuraminidase__InfluenzaA__AHL99288

SEQ ID NO: 86016 - RNA, 1410 nt, Artificial Sequence; identical to SEQ ID NO: 85794
  derived and/or modified sequence opt1 from neuraminidase__InfluenzaA__AHL99300

SEQ ID NO: 86017 - RNA, 1410 nt, Artificial Sequence; identical to SEQ ID NO: 83154
  derived and/or modified sequence opt1 from neuraminidase__InfluenzaA__AHL99312

SEQ ID NO: 86018 - RNA, 1410 nt, Artificial Sequence
  derived and/or modified sequence opt1 from neuraminidase__InfluenzaA__AHL99324
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggcaagcucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86019 - RNA, 1410 nt, Artificial Sequence; identical to SEQ ID NO: 84397
  derived and/or modified sequence opt1 from neuraminidase__InfluenzaA__AHL99348

SEQ ID NO: 86020 - RNA, 1410 nt, Artificial Sequence; identical to SEQ ID NO: 84397
  derived and/or modified sequence opt1 from neuraminidase__InfluenzaA__AHL99359

SEQ ID NO: 86021 - RNA, 1410 nt, Artificial Sequence
  derived and/or modified sequence opt1 from neuraminidase__InfluenzaA__AHL99370
augaaccccaaccagaagaucaucaccaucggcagcgugucccugaccaucacgaccaucugcuucuucaugcagaucgccauccucaucaccaccgucacgcugcacuucaagcaguacgaguucaacagcccgcccaacaaccagaugaugcugugcgagcccaccaucaucgagcgcaacaucaccgagaucguguaccucaccaacacgaccaucgagaaggagaucugccccaagccggccgaguaccggaacugguccaagccccagugcgggaucaccggcuucgcgcccuucagcaaggacaacuccauccgccugagcgccgggggcgacaucugggugacccgggagcccuacgucuccugcgacccggacaagugcuaccaguucgcccuggggcagggcacgacccucaacaacgugcacagcaacaacaccgugcgcgaccggacccccuaccgcacgcugcugaugaacgagcucggcguccccuuccaccuggggaccaagcaggucugcaucgccugguccagcuccagcugccacgacggcaaggccuggcugcacgugugcaucaccggggacgacaagaacgcgaccgccuccuucaucuacaacggccggcucguggacagcgugguguccuggagcaaggagauccugcgcacgcaggaguccgagugcgucugcaucaacgggaccugcaccguggugaugaccgacggcagcgccuccggcaaggccgacacgaagauccuguucaucgaggaggggaagaucguccacaccagcacccucagcggcuccgcgcagcacguggaggagugcagcugcuacccccgguacccgggggugcgcugcgucugccgggacaacuggaagggcuccaaccgccccaucguggacaucaacaucaaggaccacagcaucguguccagcuacgucugcuccggccuggugggggacacgccccggaagaacgacagcuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggucaucguggaccgcggggaccggagcggcuacuccgggaucuucagcguggagggcaaguccugcaucaaccggugcuucuacgucgagcugauccgcggccggaaggaggagaccgaggugcucuggacgagcaacagcaucguggucuucugcgggaccuccggcaccuacgggaccggcagcuggcccgacggggccgaccugaaccugaugcccaucuga

SEQ ID NO: 86022 - RNA, 1410 nt, Artificial Sequence; identical to SEQ ID NO: 83154
  derived and/or modified sequence opt1 from neuraminidase__InfluenzaA__AHL99393

SEQ ID NO: 86023 - RNA, 1410 nt, Artificial Sequence; identical to SEQ ID NO: 83154
  derived and/or modified sequence opt1 from neuraminidase__InfluenzaA__AHL99417

SEQ ID NO: 86024 - RNA, 1410 nt, Artificial Sequence; identical to SEQ ID NO: 83154
  derived and/or modified sequence opt1 from neuraminidase__InfluenzaA__AHL99429

SEQ ID NO: 86025 - RNA, 1410 nt, Artificial Sequence; identical to SEQ ID NO: 83154
  derived and/or modified sequence opt1 from neuraminidase__InfluenzaA__AHL99441

SEQ ID NO: 86026 - RNA, 1410 nt, Artificial Sequence; identical to SEQ ID NO: 83154
  derived and/or modified sequence opt1 from neuraminidase__InfluenzaA__AHL99453

SEQ ID NO: 86027 - RNA, 1410 nt, Artificial Sequence; identical to SEQ ID NO: 83154
  derived and/or modified sequence opt1 from neuraminidase__InfluenzaA__AHL99477

SEQ ID NO: 86028 - RNA, 1410 nt, Artificial Sequence; identical to SEQ ID NO: 85794
  derived and/or modified sequence opt1 from neuraminidase__InfluenzaA__AHL99489

SEQ ID NO: 86029 - RNA, 1410 nt, Artificial Sequence
  derived and/or modified sequence opt1 from neuraminidase__InfluenzaA__AHL99501
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaccgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86030 - RNA, 1410 nt, Artificial Sequence; identical to SEQ ID NO: 83154
  derived and/or modified sequence opt1 from neuraminidase__InfluenzaA__AHL99525

SEQ ID NO: 86031 - RNA, 1410 nt, Artificial Sequence
  derived and/or modified sequence opt1 from neuraminidase__InfluenzaA__AHL99537
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggaccagcuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguaccccgggguccgcugcgugugccgggacaacuggaagggcuccaaccgcccgaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggccggacggggccgaccugaaccugaugcccaucuga

SEQ ID NO: 86032 - RNA, 1410 nt, Artificial Sequence; identical to SEQ ID NO: 84891
  derived and/or modified sequence opt1 from neuraminidase__InfluenzaA__AHL99549

SEQ ID NO: 86033 - RNA, 1410 nt, Artificial Sequence; identical to SEQ ID NO: 83154
  derived and/or modified sequence opt1 from neuraminidase__InfluenzaA__AHL99561

SEQ ID NO: 86034 - RNA, 1410 nt, Artificial Sequence
  derived and/or modified sequence opt1 from neuraminidase__InfluenzaA__AHL99573
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgggggagaaggagaucugccccaagccggccgaguaccggaacuggagcaagccccagugcggcaucaccggguucgcgcccuucuccaaggacaacagcauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggcuccgccagcgggaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaagggcagcaaccgccccaucaucgacaucaacaucaaggaccacuccaucgugagcuccuacgucugcagcgggcuggugggcgacaccccgcggaagaacgacuccagcuccagcucccacugccuggaccccaacaacgaggagggcgggcacggggugaagggcugggccuucgacgacggcaacgacgucuggauggggcgcaccaucaacgagacgagccggcucggcuacgagaccuucaaggugaucgaggggugguccaaccccaagagcaagcugcagaucaaccgccaggucaucguggacaagggcgaccgguccggguacagcggcaucuucuccguggagggcaagagcugcaucaaccgcugcuucuacgucgagcugauccgggggcgcaaggaggagaccgaggugcucuggaccagcaacuccaucguggucuucugcggcacgagcgggaccuacggcaccggguccuggcccgacggcgccgaccugaaccugaugcccaucuga

SEQ ID NO: 86035 - RNA, 1410 nt, Artificial Sequence
  derived and/or modified sequence opt1 from neuraminidase__InfluenzaA__AHL99585
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccugaaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86036 - RNA, 1410 nt, Artificial Sequence
  derived and/or modified sequence opt1 from neuraminidase__InfluenzaA__AHL99597
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgugggccaguccguggucagcgugaagcuggcggggaacuccagccugugcccgguguccggcugggccaucuacagcaaggacaacuccguccgcaucggcagcaagggggacguguucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggagcgccuccgcgugccacgacgggaucaacuggcugaccaucggcaucagcggccccgacuccggggccguggccguccucaaguacaacggcaucaucaccgacaccaucaagagcuggcgcaacgacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccguggggugguccuggcccgacggcgccgagcucccguucacgaucgacaaguga

SEQ ID NO: 86037 - RNA, 1410 nt, Artificial Sequence
  derived and/or modified sequence opt1 from neuraminidase__InfluenzaA__AHL99608
augaaccccaaccagaagaucaucaccaucggcagcgugucccugaccaucagcacgaucugcgucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86038 - RNA, 1410 nt, Artificial Sequence
  derived and/or modified sequence opt1 from neuraminidase__InfluenzaA__AHL99620
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggcaagcucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86039 - RNA, 1410 nt, Artificial Sequence
  derived and/or modified sequence opt1 from neuraminidase__InfluenzaA__AHL99632
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86040 - RNA, 1410 nt, Artificial Sequence; identical to SEQ ID NO: 85829
  derived and/or modified sequence opt1 from neuraminidase__InfluenzaA__AHL99644

SEQ ID NO: 86041 - RNA, 1410 nt, Artificial Sequence
  derived and/or modified sequence opt1 from neuraminidase__InfluenzaA__AHL99668
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucaucgacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86042 - RNA, 1410 nt, Artificial Sequence; identical to SEQ ID NO: 83154
  derived and/or modified sequence opt1 from neuraminidase__InfluenzaA__AHL99680

SEQ ID NO: 86043 - RNA, 1410 nt, Artificial Sequence
  derived and/or modified sequence opt1 from neuraminidase__InfluenzaA__AHL99692
augaaccccaaccagaagaucaucaccaucggcagcgugucccugaccaucagcacgaccugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86044 - RNA, 1410 nt, Artificial Sequence; identical to SEQ ID NO: 83154
  derived and/or modified sequence opt1 from neuraminidase__InfluenzaA__AHL99704

SEQ ID NO: 86045 - RNA, 1410 nt, Artificial Sequence; identical to SEQ ID NO: 83154
  derived and/or modified sequence opt1 from neuraminidase__InfluenzaA__AHL99716

SEQ ID NO: 86046 - RNA, 1410 nt, Artificial Sequence; identical to SEQ ID NO: 86036
  derived and/or modified sequence opt1 from neuraminidase__InfluenzaA__AHL99740

SEQ ID NO: 86047 - RNA, 1410 nt, Artificial Sequence
  derived and/or modified sequence opt1 from neuraminidase__InfluenzaA__AHL99751
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgcccgcgaccggacccccuaccgcacccugcugaugaacgagcucggcgugcccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggcggacaccaagauccuguucaucgaggaggggaagaucgugcacacgagcacccucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccugaaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86048 - RNA, 1410 nt, Artificial Sequence
  derived and/or modified sequence opt1 from neuraminidase__InfluenzaA__AHL99763
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaugaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86049 - RNA, 1410 nt, Artificial Sequence; identical to SEQ ID NO: 83154
  derived and/or modified sequence opt1 from neuraminidase__InfluenzaA__AHL99775

SEQ ID NO: 86050 - RNA, 1410 nt, Artificial Sequence
  derived and/or modified sequence opt1 from neuraminidase__InfluenzaA__AHL99787
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaacccggagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86051 - RNA, 1410 nt, Artificial Sequence
  derived and/or modified sequence opt1 from neuraminidase__InfluenzaA__AHL99799
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcaucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccugggccccaacaacgaggagggcgggcacggggugaagggcugggccuucgacgacggcaacgacgucuggauggggcgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 86052 - RNA, 1410 nt, Artificial Sequence; identical to SEQ ID NO: 83154
  derived and/or modified sequence opt1 from neuraminidase__InfluenzaA__AHL99811

SEQ ID NO: 86053 - RNA, 1410 nt, Artificial Sequence
  derived and/or modified sequence opt1 from neuraminidase__InfluenzaA__AHL99823
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcgccguggucaugaccgacggcuccgccagcggcaaggcggacaccaagauccuguucaucgaggaggggaagaucgugcacaccagcacgcucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 86054 - RNA, 1410 nt, Artificial Sequence
  derived and/or modified sequence opt1 from neuraminidase__InfluenzaA__AHL99835
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgccccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggcggacaccaagauccuguucaucgaggaggggaagaucgugcacacgagcacccucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcugaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 86055 - RNA, 1410 nt, Artificial Sequence; identical to SEQ ID NO: 83154
  derived and/or modified sequence opt1 from neuraminidase__InfluenzaA__AHL99847

SEQ ID NO: 86056 - RNA, 1410 nt, Artificial Sequence; identical to SEQ ID NO: 84383
  derived and/or modified sequence opt1 from neuraminidase__InfluenzaA__AHL99859

SEQ ID NO: 86057 - RNA, 1410 nt, Artificial Sequence
  derived and/or modified sequence opt1 from neuraminidase__InfluenzaA__AHL99871
augaaccccaaccagaagaucaucaccaucggcagcgugucccugaccaucagcacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggccggaucgugcacaccagcacccucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagccgcuacgugugcuccggccuggugggcgacacgccccggaagaacgacagcuccagcuccagccacugccuggaccccaacaacgaggagggcggccacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgaggggaaguccugcaucaaccggugcuucuacguggagcugauccgcggccgcaaggaggagaccgaggugcucuggacgagcaacagcaucgucguguucugcggcaccuccgggaccuacggcaccgggagcuggcccgacggcgccgaccugaaccugaugcccaucuga

SEQ ID NO: 86058 - RNA, 1410 nt, Artificial Sequence; identical to SEQ ID NO: 83154
  derived and/or modified sequence opt1 from neuraminidase__InfluenzaA__AHL99883

SEQ ID NO: 86059 - RNA, 1410 nt, Artificial Sequence; identical to SEQ ID NO: 86035
  derived and/or modified sequence opt1 from neuraminidase__InfluenzaA__AHL99895

SEQ ID NO: 86060 - RNA, 1410 nt, Artificial Sequence; identical to SEQ ID NO: 83154
  derived and/or modified sequence opt1 from neuraminidase__InfluenzaA__AHL99907

SEQ ID NO: 86061 - RNA, 1410 nt, Artificial Sequence; identical to SEQ ID NO: 83154
  derived and/or modified sequence opt1 from neuraminidase__InfluenzaA__AHL99919

SEQ ID NO: 86062 - RNA, 1410 nt, Artificial Sequence
  derived and/or modified sequence opt1 from neuraminidase__InfluenzaA__AHL99943
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86063 - RNA, 1410 nt, Artificial Sequence; identical to SEQ ID NO: 83154
  derived and/or modified sequence opt1 from neuraminidase__InfluenzaA__AHL99955

SEQ ID NO: 86064 - RNA, 1410 nt, Artificial Sequence
  derived and/or modified sequence opt1 from neuraminidase__InfluenzaA__AHL99967
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccacgaccgcacccccuaccggacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaugaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86065 - RNA, 1410 nt, Artificial Sequence
  derived and/or modified sequence opt1 from neuraminidase__InfluenzaA__AHL99979
augaaccccaaccagaagaucaucaccaucggcagcgugucccugaccaucagcacgaucugcuucuucaugcagaucgccauccucaucaccaccgucgcccugcacuucaagcagcacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggagcaagccccagugcgggaucacgggcuucgcccccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggcguggcugcacgugugcaucacgggggacgacaagaacgccaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggcggacaccaagauccuguucaucgaggaggggaagaucgugcacaccagcacgcucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 86066 - RNA, 1410 nt, Artificial Sequence; identical to SEQ ID NO: 86062
  derived and/or modified sequence opt1 from neuraminidase__InfluenzaA__AHL99991

SEQ ID NO: 86067 - RNA, 1410 nt, Artificial Sequence; identical to SEQ ID NO: 83154
  derived and/or modified sequence opt1 from neuraminidase__InfluenzaA__AHM00004

SEQ ID NO: 86068 - RNA, 1410 nt, Artificial Sequence; identical to SEQ ID NO: 83154
  derived and/or modified sequence opt1 from neuraminidase__InfluenzaA__AHM00016

SEQ ID NO: 86069 - RNA, 1410 nt, Artificial Sequence; identical to SEQ ID NO: 83154
  derived and/or modified sequence opt1 from neuraminidase__InfluenzaA__AHM00028

SEQ ID NO: 86070 - RNA, 1410 nt, Artificial Sequence; identical to SEQ ID NO: 86062
  derived and/or modified sequence opt1 from neuraminidase__InfluenzaA__AHM00040

SEQ ID NO: 86071 - RNA, 1410 nt, Artificial Sequence; identical to SEQ ID NO: 83154
  derived and/or modified sequence opt1 from neuraminidase__InfluenzaA__AHM00052

SEQ ID NO: 86072 - RNA, 1410 nt, Artificial Sequence; identical to SEQ ID NO: 84018
  derived and/or modified sequence opt1 from neuraminidase__InfluenzaA__AHM00064

SEQ ID NO: 86073 - RNA, 1410 nt, Artificial Sequence; identical to SEQ ID NO: 83154
  derived and/or modified sequence opt1 from neuraminidase__InfluenzaA__AHM00076

SEQ ID NO: 86074 - RNA, 1410 nt, Artificial Sequence; identical to SEQ ID NO: 83154
  derived and/or modified sequence opt1 from neuraminidase__InfluenzaA__AHM00088

SEQ ID NO: 86075 - RNA, 1410 nt, Artificial Sequence
  derived and/or modified sequence opt1 from neuraminidase__InfluenzaA__AHM00100
augaaccccaaccagaagaucaucaccaucggcagcaucugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcgucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccacgaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaacuga

SEQ ID NO: 86076 - RNA, 1410 nt, Artificial Sequence; identical to SEQ ID NO: 85998
  derived and/or modified sequence opt1 from neuraminidase__InfluenzaA__AHM00111

SEQ ID NO: 86077 - RNA, 1410 nt, Artificial Sequence; identical to SEQ ID NO: 86062
  derived and/or modified sequence opt1 from neuraminidase__InfluenzaA__AHM00123

SEQ ID NO: 86078 - RNA, 1410 nt, Artificial Sequence; identical to SEQ ID NO: 84383
  derived and/or modified sequence opt1 from neuraminidase__InfluenzaA__AHM00135

SEQ ID NO: 86079 - RNA, 1410 nt, Artificial Sequence; identical to SEQ ID NO: 84891
  derived and/or modified sequence opt1 from neuraminidase__InfluenzaA__AHM00147

SEQ ID NO: 86080 - RNA, 1410 nt, Artificial Sequence; identical to SEQ ID NO: 86062
  derived and/or modified sequence opt1 from neuraminidase__InfluenzaA__AHM00159

SEQ ID NO: 86081 - RNA, 1410 nt, Artificial Sequence; identical to SEQ ID NO: 83154
  derived and/or modified sequence opt1 from neuraminidase__InfluenzaA__AHM00171

SEQ ID NO: 86082 - RNA, 1410 nt, Artificial Sequence; identical to SEQ ID NO: 83154
  derived and/or modified sequence opt1 from neuraminidase__InfluenzaA__AHM00183

SEQ ID NO: 86083 - RNA, 1410 nt, Artificial Sequence
  derived and/or modified sequence opt1 from neuraminidase__InfluenzaA__AHM00195
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaaggugcuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagccgguacgugugcuccggccuggucggcgacacgccccgcaagaacgacagcuccagcuccagccacugccuggaccccaacaacgaggagggcgggcacggggugaagggcugggccuucgacgacgggaacgacgucuggaugggccggaccaucaacgagaccucccgccucggcuacgagaccuucaaggugaucgagggguggagcaacccgaaguccaagcugcagaucaaccgccaggugaucgucgaccggggcgaccggagcggguacuccggcaucuucagcguggaggggaaguccugcaucaaccgcugcuucuacguggagcugauccggggccgcaaggaggagaccgagguccucuggaccagcaacagcaucgugguguucugcggcacguccgggaccuacggcaccgggagcuggcccgacggcgccgaccugaaccugaugcccaucuga

SEQ ID NO: 86084 - RNA, 1410 nt, Artificial Sequence
  derived and/or modified sequence opt1 from neuraminidase__InfluenzaA__AHM00207
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcaacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86085 - RNA, 1410 nt, Artificial Sequence; identical to SEQ ID NO: 86062
  derived and/or modified sequence opt1 from neuraminidase__InfluenzaA__AHM00219

SEQ ID NO: 86086 - RNA, 1410 nt, Artificial Sequence; identical to SEQ ID NO: 83154
  derived and/or modified sequence opt1 from neuraminidase__InfluenzaA__AHM00231

SEQ ID NO: 86087 - RNA, 1410 nt, Artificial Sequence; identical to SEQ ID NO: 83154
  derived and/or modified sequence opt1 from neuraminidase__InfluenzaA__AHM00243

SEQ ID NO: 86088 - RNA, 1410 nt, Artificial Sequence; identical to SEQ ID NO: 83154
  derived and/or modified sequence opt1 from neuraminidase__InfluenzaA__AHM00255

SEQ ID NO: 86089 - RNA, 1410 nt, Artificial Sequence
  derived and/or modified sequence opt1 from neuraminidase__InfluenzaA__AHM00267
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggccagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86090 - RNA, 1410 nt, Artificial Sequence; identical to SEQ ID NO: 84383
  derived and/or modified sequence opt1 from neuraminidase__InfluenzaA__AHM00279

SEQ ID NO: 86091 - RNA, 1410 nt, Artificial Sequence; identical to SEQ ID NO: 83154
  derived and/or modified sequence opt1 from neuraminidase__InfluenzaA__AHM00291

SEQ ID NO: 86092 - RNA, 1410 nt, Artificial Sequence; identical to SEQ ID NO: 83154
  derived and/or modified sequence opt1 from neuraminidase__InfluenzaA__AHM00303

SEQ ID NO: 86093 - RNA, 1410 nt, Artificial Sequence; identical to SEQ ID NO: 83154
  derived and/or modified sequence opt1 from neuraminidase__InfluenzaA__AHM00315

SEQ ID NO: 86094 - RNA, 1410 nt, Artificial Sequence; identical to SEQ ID NO: 84383
  derived and/or modified sequence opt1 from neuraminidase__InfluenzaA__AHM00327

SEQ ID NO: 86095 - RNA, 1410 nt, Artificial Sequence; identical to SEQ ID NO: 84383
  derived and/or modified sequence opt1 from neuraminidase__InfluenzaA__AHM00339

SEQ ID NO: 86096 - RNA, 1410 nt, Artificial Sequence; identical to SEQ ID NO: 86062
  derived and/or modified sequence opt1 from neuraminidase__InfluenzaA__AHM00351

SEQ ID NO: 86097 - RNA, 1410 nt, Artificial Sequence; identical to SEQ ID NO: 85998
  derived and/or modified sequence opt1 from neuraminidase__InfluenzaA__AHM00363

SEQ ID NO: 86098 - RNA, 1410 nt, Artificial Sequence
  derived and/or modified sequence opt1 from neuraminidase__InfluenzaA__AHM00375
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggaggucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86099 - RNA, 1410 nt, Artificial Sequence
  derived and/or modified sequence opt1 from neuraminidase__InfluenzaA__AHM00398
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggagaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcuccagcaucgucguguucugcgggacguccggcaccuacgggaccggcagcuggcccgacggggccgaccugaaccugaugcccaucuga

SEQ ID NO: 86100 - RNA, 1410 nt, Artificial Sequence; identical to SEQ ID NO: 83154
  derived and/or modified sequence opt1 from neuraminidase__InfluenzaA__AHM00410

SEQ ID NO: 86101 - RNA, 1410 nt, Artificial Sequence
  derived and/or modified sequence opt1 from neuraminidase__InfluenzaA__AHM00422
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86102 - RNA, 1410 nt, Artificial Sequence
  derived and/or modified sequence opt1 from neuraminidase__InfluenzaA__AHM00434
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccgcgguaccccgggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86103 - RNA, 1410 nt, Artificial Sequence; identical to SEQ ID NO: 83154
  derived and/or modified sequence opt1 from neuraminidase__InfluenzaA__AHM00446

SEQ ID NO: 86104 - RNA, 1410 nt, Artificial Sequence; identical to SEQ ID NO: 86062
  derived and/or modified sequence opt1 from neuraminidase__InfluenzaA__AHM00458

SEQ ID NO: 86105 - RNA, 1410 nt, Artificial Sequence; identical to SEQ ID NO: 86062
  derived and/or modified sequence opt1 from neuraminidase__InfluenzaA__AHM00470

SEQ ID NO: 86106 - RNA, 1410 nt, Artificial Sequence; identical to SEQ ID NO: 86062
  derived and/or modified sequence opt1 from neuraminidase__InfluenzaA__AHM00482

SEQ ID NO: 86107 - RNA, 1410 nt, Artificial Sequence; identical to SEQ ID NO: 86062
  derived and/or modified sequence opt1 from neuraminidase__InfluenzaA__AHM00494

SEQ ID NO: 86108 - RNA, 1410 nt, Artificial Sequence
  derived and/or modified sequence opt1 from neuraminidase__InfluenzaA__AHM00506
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucgugaaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86109 - RNA, 1410 nt, Artificial Sequence; identical to SEQ ID NO: 83154
  derived and/or modified sequence opt1 from neuraminidase__InfluenzaA__AHM00518

SEQ ID NO: 86110 - RNA, 1410 nt, Artificial Sequence
  derived and/or modified sequence opt1 from neuraminidase__InfluenzaA__AHM00530
augaaccccaaccagaagaucaucaccaucggcagcgugucccugaccaucagcacgaucugcuucuccaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacuggagcaagccccagugcgggaucaccggcuucgcgcccuucuccaaggacaacagcauccgccuguccgccgggggcgacaucugggucacccgggagccguacgugagcugcgaccccgacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccgcgguaccccgggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcucccacugccuggacccgaacaacgaggagggcgggcacggcgucaaggggugggccuucgacgacggcaacgacguguggaugggccgcaccaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86111 - RNA, 1410 nt, Artificial Sequence; identical to SEQ ID NO: 84383
  derived and/or modified sequence opt1 from neuraminidase__InfluenzaA__AHM00542

SEQ ID NO: 86112 - RNA, 1410 nt, Artificial Sequence
  derived and/or modified sequence opt1 from neuraminidase__InfluenzaA__AHM00546
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcaaguacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgaggggaaguccugcaucaaccggugcuucuacguggagcugauccgcggccggaaggaggagaccgaggugcucuggaccagcaacagcaucgucguguucugcggcacguccgggaccuacggcaccgggagcuggcccgacggcgccgaccugaaccugaugcccaucuga

SEQ ID NO: 86113 - RNA, 1410 nt, Artificial Sequence
  derived and/or modified sequence opt1 from neuraminidase__InfluenzaA__AHM00558
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86114 - RNA, 1410 nt, Artificial Sequence; identical to SEQ ID NO: 83154
  derived and/or modified sequence opt1 from neuraminidase__InfluenzaA__AHM00570

SEQ ID NO: 86115 - RNA, 1410 nt, Artificial Sequence; identical to SEQ ID NO: 83154
  derived and/or modified sequence opt1 from neuraminidase__InfluenzaA__AHM00582

SEQ ID NO: 86116 - RNA, 1410 nt, Artificial Sequence
  derived and/or modified sequence opt1 from neuraminidase__InfluenzaA__AHM00594
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucgugcaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86117 - RNA, 1410 nt, Artificial Sequence; identical to SEQ ID NO: 83154
  derived and/or modified sequence opt1 from neuraminidase__InfluenzaA__AHM00606

SEQ ID NO: 86118 - RNA, 1410 nt, Artificial Sequence; identical to SEQ ID NO: 83154
  derived and/or modified sequence opt1 from neuraminidase__InfluenzaA__AHM00618

SEQ ID NO: 86119 - RNA, 1410 nt, Artificial Sequence; identical to SEQ ID NO: 83154
  derived and/or modified sequence opt1 from neuraminidase__InfluenzaA__AHM00630

SEQ ID NO: 86120 - RNA, 1410 nt, Artificial Sequence; identical to SEQ ID NO: 83154
  derived and/or modified sequence opt1 from neuraminidase__InfluenzaA__AHM00642

SEQ ID NO: 86121 - RNA, 1410 nt, Artificial Sequence; identical to SEQ ID NO: 84383
  derived and/or modified sequence opt1 from neuraminidase__InfluenzaA__AHM00654

SEQ ID NO: 86122 - RNA, 1410 nt, Artificial Sequence; identical to SEQ ID NO: 83154
  derived and/or modified sequence opt1 from neuraminidase__InfluenzaA__AHM00666

SEQ ID NO: 86123 - RNA, 1410 nt, Artificial Sequence; identical to SEQ ID NO: 86062
  derived and/or modified sequence opt1 from neuraminidase__InfluenzaA__AHM00678

SEQ ID NO: 86124 - RNA, 1410 nt, Artificial Sequence; identical to SEQ ID NO: 84397
  derived and/or modified sequence opt1 from neuraminidase__InfluenzaA__AHM00690

SEQ ID NO: 86125 - RNA, 1410 nt, Artificial Sequence; identical to SEQ ID NO: 84383
  derived and/or modified sequence opt1 from neuraminidase__InfluenzaA__AHM00701

SEQ ID NO: 86126 - RNA, 1410 nt, Artificial Sequence
  derived and/or modified sequence opt1 from neuraminidase__InfluenzaA__AHM00713
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagagcgccgaguaccggaacugguccaagccgcagugcgggaucaccggcuucgcgcccuucagcaaggacaacuccauccgccugagcgccgggggcgacaucugggucacccgggagcccuacguguccugcgaccccgacaagugcuaccaguucgcccuggggcagggcaccacgcucaacaacgugcacagcaacaacaccguccgcgaccggaccccguaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguaccccgggguccgcugcgugugccgggacaacuggaagggcuccaaccgcccgaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggccggacggggccgaccugaaccugaugcccaucuga

SEQ ID NO: 86127 - RNA, 1410 nt, Artificial Sequence; identical to SEQ ID NO: 83154
  derived and/or modified sequence opt1 from neuraminidase__InfluenzaA__AHM00725

SEQ ID NO: 86128 - RNA, 1410 nt, Artificial Sequence; identical to SEQ ID NO: 83154
  derived and/or modified sequence opt1 from neuraminidase__InfluenzaA__AHM00737

SEQ ID NO: 86129 - RNA, 1410 nt, Artificial Sequence; identical to SEQ ID NO: 86062
  derived and/or modified sequence opt1 from neuraminidase__InfluenzaA__AHM00749

SEQ ID NO: 86130 - RNA, 1410 nt, Artificial Sequence; identical to SEQ ID NO: 83154
  derived and/or modified sequence opt1 from neuraminidase__InfluenzaA__AHM00761

SEQ ID NO: 86131 - RNA, 1410 nt, Artificial Sequence; identical to SEQ ID NO: 84383
  derived and/or modified sequence opt1 from neuraminidase__InfluenzaA__AHM00785

SEQ ID NO: 86132 - RNA, 1410 nt, Artificial Sequence; identical to SEQ ID NO: 84018
  derived and/or modified sequence opt1 from neuraminidase__InfluenzaA__AHM00797

SEQ ID NO: 86133 - RNA, 1410 nt, Artificial Sequence
  derived and/or modified sequence opt1 from neuraminidase__InfluenzaA__AHM00809
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 86134 - RNA, 1410 nt, Artificial Sequence; identical to SEQ ID NO: 86062
  derived and/or modified sequence opt1 from neuraminidase__InfluenzaA__AHM00821

SEQ ID NO: 86135 - RNA, 1410 nt, Artificial Sequence; identical to SEQ ID NO: 86062
  derived and/or modified sequence opt1 from neuraminidase__InfluenzaA__AHM00833

SEQ ID NO: 86136 - RNA, 1410 nt, Artificial Sequence; identical to SEQ ID NO: 84018
  derived and/or modified sequence opt1 from neuraminidase__InfluenzaA__AHM00845

SEQ ID NO: 86137 - RNA, 1410 nt, Artificial Sequence; identical to SEQ ID NO: 83154
  derived and/or modified sequence opt1 from neuraminidase__InfluenzaA__AHM00857

SEQ ID NO: 86138 - RNA, 1410 nt, Artificial Sequence; identical to SEQ ID NO: 83154
  derived and/or modified sequence opt1 from neuraminidase__InfluenzaA__AHM00869

SEQ ID NO: 86139 - RNA, 1410 nt, Artificial Sequence; identical to SEQ ID NO: 83154
  derived and/or modified sequence opt1 from neuraminidase__InfluenzaA__AHM00881

SEQ ID NO: 86140 - RNA, 1410 nt, Artificial Sequence; identical to SEQ ID NO: 84383
  derived and/or modified sequence opt1 from neuraminidase__InfluenzaA__AHM00893

SEQ ID NO: 86141 - RNA, 1410 nt, Artificial Sequence
  derived and/or modified sequence opt1 from neuraminidase__InfluenzaA__AHM00905
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaccgacuccagcuccagcggccacugccuggaccccaacaacgaggagggcgggcacggggucaagggcugggccuucgacgacggcaacgacguguggauggggcgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaaguccugcaucaaccggugcuucuacguggagcugauccgcgggcggaaggaggagaccgaggugcucuggacgagcaacagcaucgucguguucugcggcaccuccgggaccuacggcaccgggagcuggcccgacggcgccgaccugaaccugaugcccaucuga

SEQ ID NO: 86142 - RNA, 1410 nt, Artificial Sequence
  derived and/or modified sequence opt1 from neuraminidase__InfluenzaA__AHM00917
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacaucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86143 - RNA, 1410 nt, Artificial Sequence; identical to SEQ ID NO: 83154
  derived and/or modified sequence opt1 from neuraminidase__InfluenzaA__AHM00929

SEQ ID NO: 86144 - RNA, 1410 nt, Artificial Sequence
  derived and/or modified sequence opt1 from neuraminidase__InfluenzaA__AHM00941
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccauccgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagccgguacgucugcuccggccuggugggcgacacgccccgcaagaacgacagcuccagcuccagccacugccuggaccccaacaacgaggagggcgggcacggggugaagggcugggccuucgacgacgggaacgacgucuggaugggccggaccaucaacgagaccucccgccucggcuacgagaccuucaaggugaucgagggguggagcaacccgaaguccaagcugcagaucaaccggcaggucaucguggaccgcggcgaccggagcggguacuccggcaucuucagcguggaggggaaguccugcaucaaccgcugcuucuacgucgagcugauccggggccgcaaggaggagaccgaggugcucuggaccagcaacagcaucguggucuucugcggcacguccgggaccuacggcaccgggagcuggcccgacggcgccgaccugaaccugaugcccaucuga

SEQ ID NO: 86145 - RNA, 1410 nt, Artificial Sequence
  derived and/or modified sequence opt1 from neuraminidase__InfluenzaA__AHM00953
augaaccccaaccagaagaucaucaccaucggcagcgugucccugaccaucagcacgaucugcuucuucaugcagaucgccauccucaucaccaccgucacccugcacuucaagcaguacgccuucaacuccccgcccaacaaccaggugaugcugugcgagcccacgaucaucgagcgcaacaucaccgagaucguguaccucaccaacaccacgaucgagaaggagaucugccccaagccggcggaguaccggaacuggagcaagccccagugcgggaucaccggcuucgcccccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggcggacaccaagauccuguucaucgaggaggggaagaucgugcacacgagcacccucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86146 - RNA, 1410 nt, Artificial Sequence; identical to SEQ ID NO: 84383
  derived and/or modified sequence opt1 from neuraminidase__InfluenzaA__AHM00965

SEQ ID NO: 86147 - RNA, 1410 nt, Artificial Sequence; identical to SEQ ID NO: 84383
  derived and/or modified sequence opt1 from neuraminidase__InfluenzaA__AHM00977

SEQ ID NO: 86148 - RNA, 1398 nt, Artificial Sequence
  derived and/or modified sequence opt1 from neuraminidase__InfluenzaA__AHM24226
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagaugcucaagugggagagccugacgggcaccgccaagcacaacgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccuguga

SEQ ID NO: 86149 - RNA, 1398 nt, Artificial Sequence; identical to SEQ ID NO: 84462
  derived and/or modified sequence opt1 from neuraminidase__InfluenzaA__AHM24238

SEQ ID NO: 86150 - RNA, 1398 nt, Artificial Sequence
  derived and/or modified sequence opt1 from neuraminidase__InfluenzaA__AHM24250
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucaccaacauccagauggaggagcgcaccucccggaacuucaacaaccugaccaagggccucugcacgaucaacagcuggcacaucuacgggaaggacaacgccguccgcaucggcgagaacuccgacgugcuggugacccgggagcccuacgucagcugcgaccccgacgagugccgcuucuacgcccugucccagggcaccaccauccgggggaagcacagcaacggcacgauccacgaccgcucccaguaccgggcgcucaucagcuggccgcuguccagcccgcccaccguguacaacucccgcguggagugcaucggguggagcuccaccagcugccacgacggcaagucccggaugagcaucugcaucagcgggcccaacaacaacgccuccgccgucgugugguacaaccgccggcccguggccgagaucaacaccugggcgcgcaacauccugcggacgcaggagagcgagugcgucugccacaacggcgugugccccguggucuucaccgacggcuccgccaccgggcccgccgacacccgcaucuacuacuucaaggagggcaagauccucaagugggagagccugacggggaccgccaagcacaucgaggagugcuccugcuacggcgagcggaccggcaucacgugcacgugccgcgacaacuggcaggggagcaaccggcccgugauccagaucgacccgguggccaugacccacaccucccaguacaucugcagccccguccugaccgacaacccccgccccaacgacccgaacaucggcaagugcaacgaccccuaccccgggaacaacaacaacggcgugaagggguucuccuaccucgacggcgcgaacaccuggcugggccggaccaucagcaccgccucccgcagcggguacgagaugcugaaggugcccaacgcccucaccgacgaccgguccaagccgauccagggccagacgaucguccugaacgccgacuggagcggguacuccggcagcuucauggacuacugggccgagggggacugcuaccgcgcgugcuucuacguggagcugauccgcggccggcccaaggaggacaaggugugguggaccuccaacagcaucgucuccaugugcagcagcaccgaguuccucggccaguggaacuggcccgacggggccaagaucgaguacuuccuguga

SEQ ID NO: 86151 - RNA, 1410 nt, Artificial Sequence; identical to SEQ ID NO: 81717
  derived and/or modified sequence opt1 from neuraminidase__InfluenzaA__AHM98312

SEQ ID NO: 86152 - RNA, 1410 nt, Artificial Sequence
  derived and/or modified sequence opt1 from neuraminidase__InfluenzaA__AHM98331
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcguccacuccgacaccgugggguggagcuggcccgacggcgccgagcugccguucacgaucgacaaguga

SEQ ID NO: 86153 - RNA, 1410 nt, Artificial Sequence; identical to SEQ ID NO: 81733
  derived and/or modified sequence opt1 from neuraminidase__InfluenzaA__AHM98342

SEQ ID NO: 86154 - RNA, 1410 nt, Artificial Sequence
  derived and/or modified sequence opt1 from neuraminidase__InfluenzaA__AHM98353
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcguggacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86155 - RNA, 1410 nt, Artificial Sequence
  derived and/or modified sequence opt1 from neuraminidase__InfluenzaA__AHM98364
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaaccuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86156 - RNA, 1410 nt, Artificial Sequence
  derived and/or modified sequence opt1 from neuraminidase__InfluenzaA__AHM98375
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuuccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86157 - RNA, 1410 nt, Artificial Sequence; identical to SEQ ID NO: 81717
  derived and/or modified sequence opt1 from neuraminidase__InfluenzaA__AHM98386

SEQ ID NO: 86158 - RNA, 1410 nt, Artificial Sequence
  derived and/or modified sequence opt1 from neuraminidase__InfluenzaA__AHM98408
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacuccuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 86159 - RNA, 1410 nt, Artificial Sequence; identical to SEQ ID NO: 86158
  derived and/or modified sequence opt1 from neuraminidase__InfluenzaA__AHM98419

SEQ ID NO: 86160 - RNA, 1410 nt, Artificial Sequence
  derived and/or modified sequence opt1 from neuraminidase__InfluenzaA__AHM98430
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucgugccggugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccguggguguccuucaaccagaaccucgaguaccagaucggguacaucugcagcggcaucuucggggacaacccccggcccaacgacaagaccggcuccugcggccccgucagcuccaacggggccaacggcgugaagggguucagcuucaaguacggcaacgggguguggaucggccgcaccaaguccaucagcagccggaagggcuucgagaugaucugggacccgaacggguggaccggcaccgacaacaacuucuccaucaagcaggacaucgucgggaucaacgaguggagcggcuacuccgggagcuucgugcagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 86161 - RNA, 1410 nt, Artificial Sequence; identical to SEQ ID NO: 81965
  derived and/or modified sequence opt1 from neuraminidase__InfluenzaA__AHM98441

SEQ ID NO: 86162 - RNA, 1410 nt, Artificial Sequence
  derived and/or modified sequence opt1 from neuraminidase__InfluenzaA__AHM98452
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcgugaacgaguggagcggguacuccggcagcuucgugcagcacccggagcugacggggcuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 86163 - RNA, 1410 nt, Artificial Sequence; identical to SEQ ID NO: 81717
  derived and/or modified sequence opt1 from neuraminidase__InfluenzaA__AHM98474

SEQ ID NO: 86164 - RNA, 1410 nt, Artificial Sequence
  derived and/or modified sequence opt1 from neuraminidase__InfluenzaA__AHM98485
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggucgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86165 - RNA, 1410 nt, Artificial Sequence
  derived and/or modified sequence opt1 from neuraminidase__InfluenzaA__AHM98496
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaagaaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucaagugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcacgaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 86166 - RNA, 1410 nt, Artificial Sequence; identical to SEQ ID NO: 81717
  derived and/or modified sequence opt1 from neuraminidase__InfluenzaA__AHM98507

SEQ ID NO: 86167 - RNA, 1410 nt, Artificial Sequence
  derived and/or modified sequence opt1 from neuraminidase__InfluenzaA__AHM98518
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaugagcuucugcggcgugaacuccgacaccgucggguggagcuggcccgacggcgccgagcugccguucacgaucgacaaguga

SEQ ID NO: 86168 - RNA, 1410 nt, Artificial Sequence; identical to SEQ ID NO: 81265
  derived and/or modified sequence opt1 from neuraminidase__InfluenzaA__AHM98529

SEQ ID NO: 86169 - RNA, 1410 nt, Artificial Sequence; identical to SEQ ID NO: 82009
  derived and/or modified sequence opt1 from neuraminidase__InfluenzaA__AHM98540

SEQ ID NO: 86170 - RNA, 1410 nt, Artificial Sequence
  derived and/or modified sequence opt1 from neuraminidase__InfluenzaA__AHM98562
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaaggccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcuacaccguggggugguccuggcccgacggcgcggagcugccguucaccaucgacaaguga

SEQ ID NO: 86171 - RNA, 1410 nt, Artificial Sequence; identical to SEQ ID NO: 86160
  derived and/or modified sequence opt1 from neuraminidase__InfluenzaA__AHM98573

SEQ ID NO: 86172 - RNA, 1410 nt, Artificial Sequence
  derived and/or modified sequence opt1 from neuraminidase__InfluenzaA__AHM98584
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugcgcuacaacggcaucaucaccgacaccaucaaguccuggcggaacaacauccugcgcacgcaggagagcgagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacuccuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 86173 - RNA, 1410 nt, Artificial Sequence; identical to SEQ ID NO: 86160
  derived and/or modified sequence opt1 from neuraminidase__InfluenzaA__AHM98595

SEQ ID NO: 86174 - RNA, 1410 nt, Artificial Sequence; identical to SEQ ID NO: 81717
  derived and/or modified sequence opt1 from neuraminidase__InfluenzaA__AHM98606

SEQ ID NO: 86175 - RNA, 1410 nt, Artificial Sequence
  derived and/or modified sequence opt1 from neuraminidase__InfluenzaA__AHM98617
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccugggcugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccgucgccuggagcgcguccgccugccacgacggcaucaacuggcucaccaucggcaucagcgggcccgacaacggcgccguggccgugcugaaguacaacgggaucaucaccgacaccaucaaguccuggcgcaacaacauccugcggacgcaggagagcgagugcgcgugcgucaacggcuccugcuucaccaucaugaccgacggcccgagcgacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaagagcaucuccagccggaagggguucgagaugaucugggaccccaacggcuggaccgggaccgacaacuccuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 86176 - RNA, 1410 nt, Artificial Sequence; identical to SEQ ID NO: 86158
  derived and/or modified sequence opt1 from neuraminidase__InfluenzaA__AHM98628

SEQ ID NO: 86177 - RNA, 1410 nt, Artificial Sequence
  derived and/or modified sequence opt1 from neuraminidase__InfluenzaA__AHM98639
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaucuacgagaacaacaccuggaucaaccagaccuacgugaacaucagcaacaccaacuucgccgcggagcaguccguggucagcgugaagcuggccggcaacuccagccucugcccgguguccgggugggccaucuacagcaaggacaacuccauccgcaucggcagcaagggcgacgucuucgugauccgggagcccuucaucuccugcagcccccuggagugccgcacguucuuccugacccagggggcccuccugaacgacaagcacuccaacggcaccaucaaggaccggagccccuaccgcacccugauguccugcccgaucggggaggugcccagccccuacaacagccgguucgaguccgucgccuggagcgcguccgccugccacgacggcaucaacuggcucacgaucgggaucagcggccccgacaacggcgccguggccgugcugaaguacaacgggaucaucaccgacaccaucaaguccuggcgcaacaacauccugcggacccaggagagcgagugcgcgugcgucaacggcuccugcuucacgaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggguccugcggccccgugagcuccaacggcgccaacggggucaagggcuucagcuucaaguacgggaacggcguguggaucgggcgcaccaagagcaucuccagccggaagggcuucgagaugaucugggaccccaacggcuggaccgggaccgacaacuccuucagcaucaagcaggacaucgugggcaucaacgagugguccggguacagcggcuccuucguccagcacccggagcugaccgggcuggacugcauccgccccugcuucuggguggagcucauccggggccgccccaaggagaacacgaucuggaccagcggcuccagcaucuccuucugcggggugaacagcgacaccgucggcugguccuggcccgacggggccgagcugccguucaccaucgacaaguga

SEQ ID NO: 86178 - RNA, 1410 nt, Artificial Sequence; identical to SEQ ID NO: 81717
  derived and/or modified sequence opt1 from neuraminidase__InfluenzaA__AHM98650

SEQ ID NO: 86179 - RNA, 1410 nt, Artificial Sequence; identical to SEQ ID NO: 81717
  derived and/or modified sequence opt1 from neuraminidase__InfluenzaA__AHM98661

SEQ ID NO: 86180 - RNA, 1410 nt, Artificial Sequence
  derived and/or modified sequence opt1 from neuraminidase__InfluenzaA__AHM98672
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcggagcagagcgucgugccggugaagcuggccggcaacuccagccucugccccgucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggagcccguaccgcacgcugauguccugccccaucggggagguccccagccccuacaacucccgguucgagagcguggccuggagcgcguccgccugccacgacggcaucaacuggcucaccaucgggaucagcggcccggacaacggcgccguggccguccugaaguacaacgggaucaucaccgacaccaucaaguccuggcgcaacaacauccugcggacgcaggagagcgagugcgcgugcgugaacggcuccugcuucaccaucaugaccgacgggcccagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgcccguggguguccuucaaccagaaccucgaguaccagaucggcuacaucugcagcgggaucuucggcgacaacccccggcccaacgacaagaccggguccugcggccccgucagcuccaacggcgccaacggggugaagggcuucagcuucaaguacgggaacggcguguggaucgggcgcaccaaguccaucagcagccggaagggcuucgagaugaucugggacccgaacggcuggaccgggaccgacaacaacuucuccaucaagcaggacaucgucggcaucaacgaguggagcggguacuccggcagcuucgugcagcaccccgagcugacggggcuggacugcauccgccccugcuucuggguggagcucauccggggccgccccaaggagaacaccaucuggaccuccggcagcuccaucagcuucugcggggucaacuccgacaccgugggcuggagcuggccggacggggccgagcugcccuucacgaucgacaaguga

SEQ ID NO: 86181 - RNA, 1410 nt, Artificial Sequence
  derived and/or modified sequence opt1 from neuraminidase__InfluenzaA__AHM98683
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgacgccggccagagcgucguguccgugcgccuggcggggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgccagcgcgugccacgacggguucaacuggcucaccaucggcaucuccggccccgacaacggggccguggccguccugaaguacaacggcaucaucaccgacaccauccggagcuggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86182 - RNA, 1410 nt, Artificial Sequence; identical to SEQ ID NO: 81717
  derived and/or modified sequence opt1 from neuraminidase__InfluenzaA__AHM98693

SEQ ID NO: 86183 - RNA, 1410 nt, Artificial Sequence; identical to SEQ ID NO: 84166
  derived and/or modified sequence opt1 from neuraminidase__InfluenzaA__AHM98704

SEQ ID NO: 86184 - RNA, 1410 nt, Artificial Sequence; identical to SEQ ID NO: 84166
  derived and/or modified sequence opt1 from neuraminidase__InfluenzaA__AHM98715

SEQ ID NO: 86185 - RNA, 1410 nt, Artificial Sequence; identical to SEQ ID NO: 81717
  derived and/or modified sequence opt1 from neuraminidase__InfluenzaA__AHM98726

SEQ ID NO: 86186 - RNA, 1410 nt, Artificial Sequence
  derived and/or modified sequence opt1 from neuraminidase__InfluenzaA__AHM98737
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaacuacgagaacaacaccugggugaaccagaccuacgugaacaucagcaacaccaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucgucuccugcagcccccuggagugccggacguucuuccugacccagggggcccuccugaacgacaagcacuccaacggcaccaucaaggaccgcagccccuaccggacccugauguccugcccgaucggggaggugcccagccccuacaacagccgcuucgaguccguggccuggagcgcguccgccugccacgacggcaucaacuggcucacgaucgggaucagcggccccgacaacggcgccgucgccgugcugaaguacaacgggaucaucaccgacaccaucaaguccuggcggaacgacauccugcgcacccaggagagcgagugcgcgugcgugaacggcuccugcuucacgaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccugggucuccuucaaccagaaccucgaguaccagaucggcuacaucugcagcgggaucuucggcgacaacccgcgccccaacgacaagaccggguccugcggccccgugagcuccaacggcgccaacggggugaagggcuucagcuucaaguacgggaacggcgucuggaucgggcggaccaagagcaucuccagccgcaagggcuucgagaugaucugggaccccaacggcuggaccgggaccgacaacaacuucuccaucaagcaggacaucgugggcaucaacgaguggagcggguacuccggcagcuucgugcagcacccggagcugaccgggcuggacugcauccggcccugcuucugggucgagcucauccgcggccggcccaaggagaacacgaucuggaccuccggcagcuccaucagcuucugcggggugaacuccgacaccgucggcuggagcuggcccgacggggccgagcugccguucaccaucgacaaguga

SEQ ID NO: 86187 - RNA, 1410 nt, Artificial Sequence; identical to SEQ ID NO: 84166
  derived and/or modified sequence opt1 from neuraminidase__InfluenzaA__AHM98748

SEQ ID NO: 86188 - RNA, 1410 nt, Artificial Sequence; identical to SEQ ID NO: 84166
  derived and/or modified sequence opt1 from neuraminidase__InfluenzaA__AHM98759

SEQ ID NO: 86189 - RNA, 1410 nt, Artificial Sequence
  derived and/or modified sequence opt1 from neuraminidase__InfluenzaA__AHM98770
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgccaucaccuacgagaacaacaccugggucaaccagaccuacgugaacaucagcaacacgaacuucgcggccgggcaguccguggucagcgugaagcuggccggcaacuccagccucugcccgguguccgggugggccaucuacagcaaggacaacuccauccggaucggcagcaagggcgacgucuucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggaggugcccagccccuacaacagccgcuucgaguccgucgcguggagcgccuccgccugccacgacggcaucaacuggcucaccaucgggaucagcggccccgacaacggcgccguggcggugcugaaguacaacgggaucaucaccgacaccaucaaguccuggcggaacaacauccugcgcacgcaggagagcgagugcgccugcgucaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgugagcuccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggagcggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggcggagcugccguucacgaucgacaaguga

SEQ ID NO: 86190 - RNA, 1410 nt, Artificial Sequence
  derived and/or modified sequence opt1 from neuraminidase__InfluenzaA__AHM98781
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccagcgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacuccuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgggaccgugggcugguccuggcccgacggcgccgagcugccguucacgaucgacaaguga

SEQ ID NO: 86191 - RNA, 1410 nt, Artificial Sequence; identical to SEQ ID NO: 81717
  derived and/or modified sequence opt1 from neuraminidase__InfluenzaA__AHM98801

SEQ ID NO: 86192 - RNA, 1410 nt, Artificial Sequence; identical to SEQ ID NO: 81265
  derived and/or modified sequence opt1 from neuraminidase__InfluenzaA__AHM98812

SEQ ID NO: 86193 - RNA, 1410 nt, Artificial Sequence
  derived and/or modified sequence opt1 from neuraminidase__InfluenzaA__AHM98823
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacaucaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagccccuccgagugccgcaccuucuuccugacccagggcgcccugcucaacgacaagcacagcaacgggaccaucaaggaccggucccccuaccgcacgcugaugagcugcccgaucggcgaggugcccagccccuacaacucccgguucgagagcgucgccugguccgcgagcgccugccacgacgggaucaacuggcugaccaucggcaucuccggccccgacaacggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 86194 - RNA, 1410 nt, Artificial Sequence
  derived and/or modified sequence opt1 from neuraminidase__InfluenzaA__AHM98839
augaaccccaaccagaagaucaucaccaucggcagcgugugcaugaccgucgggauggccaaccugauccuccagaucggcaacaucaucuccaucuggaucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86195 - RNA, 1410 nt, Artificial Sequence; identical to SEQ ID NO: 81265
  derived and/or modified sequence opt1 from neuraminidase__InfluenzaA__AHM98850

SEQ ID NO: 86196 - RNA, 1410 nt, Artificial Sequence; identical to SEQ ID NO: 81265
  derived and/or modified sequence opt1 from neuraminidase__InfluenzaA__AHM98861

SEQ ID NO: 86197 - RNA, 1410 nt, Artificial Sequence
  derived and/or modified sequence opt1 from neuraminidase__InfluenzaA__AHM98901
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86198 - RNA, 1410 nt, Artificial Sequence; identical to SEQ ID NO: 84854
  derived and/or modified sequence opt1 from neuraminidase__InfluenzaA__AHM98912

SEQ ID NO: 86199 - RNA, 1410 nt, Artificial Sequence; identical to SEQ ID NO: 84854
  derived and/or modified sequence opt1 from neuraminidase__InfluenzaA__AHM98923

SEQ ID NO: 86200 - RNA, 1410 nt, Artificial Sequence; identical to SEQ ID NO: 84854
  derived and/or modified sequence opt1 from neuraminidase__InfluenzaA__AHM98935

SEQ ID NO: 86201 - RNA, 1410 nt, Artificial Sequence; identical to SEQ ID NO: 84854
  derived and/or modified sequence opt1 from neuraminidase__InfluenzaA__AHM98943

SEQ ID NO: 86202 - RNA, 1410 nt, Artificial Sequence; identical to SEQ ID NO: 84854
  derived and/or modified sequence opt1 from neuraminidase__InfluenzaA__AHM98954

SEQ ID NO: 86203 - RNA, 1410 nt, Artificial Sequence; identical to SEQ ID NO: 84854
  derived and/or modified sequence opt1 from neuraminidase__InfluenzaA__AHM98972

SEQ ID NO: 86204 - RNA, 1410 nt, Artificial Sequence; identical to SEQ ID NO: 84854
  derived and/or modified sequence opt1 from neuraminidase__InfluenzaA__AHM98978

SEQ ID NO: 86205 - RNA, 1410 nt, Artificial Sequence; identical to SEQ ID NO: 84854
  derived and/or modified sequence opt1 from neuraminidase__InfluenzaA__AHM98990

SEQ ID NO: 86206 - RNA, 1410 nt, Artificial Sequence; identical to SEQ ID NO: 84854
  derived and/or modified sequence opt1 from neuraminidase__InfluenzaA__AHM99000

SEQ ID NO: 86207 - RNA, 1410 nt, Artificial Sequence; identical to SEQ ID NO: 84854
  derived and/or modified sequence opt1 from neuraminidase__InfluenzaA__AHM99011

SEQ ID NO: 86208 - RNA, 1410 nt, Artificial Sequence; identical to SEQ ID NO: 84830
  derived and/or modified sequence opt1 from neuraminidase__InfluenzaA__AHM99022

SEQ ID NO: 86209 - RNA, 1410 nt, Artificial Sequence; identical to SEQ ID NO: 84830
  derived and/or modified sequence opt1 from neuraminidase__InfluenzaA__AHM99034

SEQ ID NO: 86210 - RNA, 1410 nt, Artificial Sequence; identical to SEQ ID NO: 84830
  derived and/or modified sequence opt1 from neuraminidase__InfluenzaA__AHM99046

SEQ ID NO: 86211 - RNA, 1410 nt, Artificial Sequence; identical to SEQ ID NO: 84830
  derived and/or modified sequence opt1 from neuraminidase__InfluenzaA__AHM99057

SEQ ID NO: 86212 - RNA, 1410 nt, Artificial Sequence; identical to SEQ ID NO: 84830
  derived and/or modified sequence opt1 from neuraminidase__InfluenzaA__AHM99068

SEQ ID NO: 86213 - RNA, 1410 nt, Artificial Sequence; identical to SEQ ID NO: 84854
  derived and/or modified sequence opt1 from neuraminidase__InfluenzaA__AHM99078

SEQ ID NO: 86214 - RNA, 1410 nt, Artificial Sequence
  derived and/or modified sequence opt1 from neuraminidase__InfluenzaA__AHN00720
augaacaccaaccagcgcaucaucaccaucggcacgaucugccugaucguggggaucaucagccuccugcugcagaucggcaacaucgucucccucuggaucagccacuccauccagaccgaggagaagucccaccccgaggugugcaaccagagcgugaucaccuacgagaacaacaccugggucaaccagacguacaucaacaucagcaacaccaacaucgccgccgggcagggcgugaccccgaucauccuggcggggaacuccagccugugccccaucuccggcugggccaucuacagcaaggacaacuccauccggaucggcagcaagggggacaucuucgugaugcgcgagcccuucaucuccugcagccaccucgagugccggaccuucuuccugacgcagggcgcccugcucaacgaccgccacuccaacgggaccgucaaggaccggagccccuaccgcacccugauguccugcccgaucggcgaggcccccagccccuacaacucccgguucgagagcguggccuggagcgcguccgccugccacgacgggaugggcuggcugaccaucggcaucagcgggcccgacaacggcgccguggccguccucaaguacaacgggaucaucacggacaccaugaaguccuggcgcaacaagauccugcggacccaggagagcgagugcgugugcaucaacggcuccugcuucaccaucaugacggacggcccgagcaacgggcaggcguccuacaagaucuucaagauggagaagggcaagaucaucaagagcaucgagcuggacgcccccaacuaccacuacgaggagugcuccugcuaccccgacaccgggaagguggucugcgugugccgcgacaacuggcacgccagcaaccggcccuggguguccuucgaccagaaccucgacuaccagaucggcuacaucugcagcggggucuucggcgacaacccgcgcuccaacgacggcaaggggaacugcggccccgugcugagcaacggggccaacggcgugaagggguucuccuuccgguacggcaacggcgucuggaucgggcgcaccaagagcaucuccagccgguccggcuucgagaugaucugggaccccaacggguggaccgagacggacagcagcuucuccaugaagcaggacaucaucgcccugaccgacuggagcggcuacuccgggagcuucgugcagcaccccgagcucaccggcaugaacugcauccgcccgugcuucuggguggagcugauccggggccagcccaaggaguccaccaucuggacgagcggguccagcaucuccuucugcggcgucaacagcgagaccgcguccuggagcuggcccgacggggccgaccugcccuucaccaucgacaaguga

SEQ ID NO: 86215 - RNA, 1410 nt, Artificial Sequence
  derived and/or modified sequence opt1 from neuraminidase__InfluenzaA__AHN00767
augaacaccaaccagcgcaucaucaccaucggcacgaucugccugaucguggggaucaucagccuccugcugcagaucggcaacaucgucucccucuggaucagccacuccauccagaccggggagaagucccaccccgaggugugcaaccagagcgugaucaccuacgagaacaacaccugggucaaccagacguacgugaacaucagcaacaccaacaucgccgccggccagggggugaccccgaucauccuggcgggcaacuccagccugugccccaucuccggcugggccaucuacagcaaggacaacuccauccggaucgggagcaagggcgacaucuucgucaugcgcgagcccuucaucuccugcagccaccucgagugccggaccuucuuccugacgcagggggcccugcucaacgaccgccacuccaacggcaccgugaaggaccggagccccuaccgcacccugauguccugcccgaucggggaggcccccagccccuacaacucccgguucgagagcguggccuggagcgcguccgccugccacgacggcaugggcuggcugaccaucgggaucagcggccccgacaacggggccgucgccgugcucaaguacaacggcaucaucacggacaccaucaaguccuggcgcaacaagauccugcggacccaggagagcgagugcgugugcaucaacggcuccugcuucaccaucaugacggacgggccgagcaacggccaggcguccuacaagaucuucaagauggagaaggggaagaucaucaagagcaucgagcuggacgcccccaacuaccacuacgaggagugcuccugcuaccccgacaccggcaaggucgugugcgugugccgcgacaacuggcacgccagcaaccggcccugggucuccuucgaccagaaccucgacuaccagaucggguacaucugcagcggcguguucggcgacaacccgcgcuccaacgacgggaagggcaacugcgggcccgugcugagcaacggcgccaacggggucaagggcuucuccuuccgguacggcaacgggguguggaucggccgcaccaagagcaucuccagccgguccggguucgagaugaucugggaccccaacggcuggaccgagacggacagcagcuucuccaugaagcaggacaucaucgcccugaccgacuggagcggguacuccggcagcuucgugcagcaccccgagcucaccggcaugaacugcauccgcccgugcuucugggucgagcugauccgggggcagcccaaggaguccaccaucuggacgagcggcuccagcaucuccuucugcggggugaacagcgagaccgcguccuggagcuggcccgacggcgccgaccugcccuucaccaucgacaaguga

SEQ ID NO: 86216 - RNA, 1398 nt, Artificial Sequence
  derived and/or modified sequence opt1 from neuraminidase__InfluenzaA__AHN96324
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucaccaacauccagauggaggagcgcaccucccggaacuucaacaaccugaccaagggccucugcacgaucaacagcuggcacaucuacgggaaggacaacgccguccgcaucggcgaguccagcgacgugcuggugacccgggagcccuacgucuccugcgaccccgacgagugccgcuucuacgcccugagccagggcaccaccauccgggggaagcacuccaacggcacgauccacgaccgcagccaguaccgggcgcucaucuccuggccgcugagcuccccgcccaccguguacaacagccgcguggagugcaucgggugguccagcaccuccugccacgacggcaagagccggaugagcaucugcaucuccgggcccaacaacaacgccagcgccgucgugugguacaaccgccggcccguggccgagaucaacaccugggcgcgcaacauccugcggacgcaggaguccgagugcgucugccacaacggcgugugccccguggucuucaccgacggcagcgccaccgggcccgccgacacccgcaucuacuacuucaaggagggcaagauccucaagugggagucccugacggggaccgccaagcacaucgaggagugcagcugcuacggcgagcggaccggcaucacgugcacgugccgcgacaacuggcagggguccaaccggcccguggugcagaucgacccggucgccaugacccacaccagccaguacaucugcucccccgugcugaccgacaacccccgccccaacgacccgaacaucggcaagugcaacgaccccuaccccgggaacaacaacaacggcgugaagggguucagcuaccucgacggcgcgaacaccuggcugggccggaccaucuccaccgccagccgcuccggguacgagaugcugaagguccccaacgcccucaccgacgaccggagcaagccgauccagggccagacgaucgugcugaacgccgacugguccggguacagcggcuccuucauggacuacugggccgagggggacugcuaccgcgcgugcuucuacguggagcugauccgcggccggcccaaggaggacaaggucugguggaccagcaacuccaucgugagcaugugcagcuccaccgaguuccucggccaguggaacuggcccgacggggccaagaucgaguacuuccuguga

SEQ ID NO: 86217 - RNA, 1410 nt, Artificial Sequence; identical to SEQ ID NO: 82151
  derived and/or modified sequence opt1 from neuraminidase__InfluenzaA__AHN96448

SEQ ID NO: 86218 - RNA, 1410 nt, Artificial Sequence; identical to SEQ ID NO: 83154
  derived and/or modified sequence opt1 from neuraminidase__InfluenzaA__AHN96450

SEQ ID NO: 86219 - RNA, 1410 nt, Artificial Sequence
  derived and/or modified sequence opt1 from neuraminidase__InfluenzaA__AHN96451
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86220 - RNA, 1410 nt, Artificial Sequence
  derived and/or modified sequence opt1 from neuraminidase__InfluenzaA__AHN96453
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucgacaacgugcacuccaacaacaccguccgcaaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccaucgagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86221 - RNA, 1410 nt, Artificial Sequence
  derived and/or modified sequence opt1 from neuraminidase__InfluenzaA__AHZ13526
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaugacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgaccgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgacggcuccagcuccagcuacugccgcaacccgaacaacgagaaggggaaccacggcgucaaggggugggccuucgacgacggcaacgacguguggaugggccggaccaucggggaggagcuccgcuccggcuacgagaccuucaaggucaucgggggcuggagcacccccaacuccaagcugcagaucaaccgccaggugaucguggacagcaacaaccgguccggguacagcggcaucuucuccgucgagggcaagagcugcaucaaccggugcuucuacguggagcugauccgcgggcgggagcaggagacccgcgugugguggacgagcaacuccaucgucguguucugcggcaccagcgggaccuacggcaccggguccuggcccgacggcgccgacaucaaccucaugcccaucuga

SEQ ID NO: 86222 - RNA, 1413 nt, Artificial Sequence; identical to SEQ ID NO: 81213
  derived and/or modified sequence opt1 from neuraminidase__InfluenzaA__AHZ13584

SEQ ID NO: 86223 - RNA, 1410 nt, Artificial Sequence; identical to SEQ ID NO: 83930
  derived and/or modified sequence opt1 from neuraminidase__InfluenzaA__AHZ35575

SEQ ID NO: 86224 - RNA, 1410 nt, Artificial Sequence; identical to SEQ ID NO: 83930
  derived and/or modified sequence opt1 from neuraminidase__InfluenzaA__AHZ35587

SEQ ID NO: 86225 - RNA, 1410 nt, Artificial Sequence
  derived and/or modified sequence opt1 from neuraminidase__InfluenzaA__AHZ35611
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgaggggcggagcugcaucaaccgcugcuucuacguggagcugauccggggccgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86226 - RNA, 1410 nt, Artificial Sequence; identical to SEQ ID NO: 83930
  derived and/or modified sequence opt1 from neuraminidase__InfluenzaA__AHZ35623

SEQ ID NO: 86227 - RNA, 1410 nt, Artificial Sequence; identical to SEQ ID NO: 83930
  derived and/or modified sequence opt1 from neuraminidase__InfluenzaA__AHZ35635

SEQ ID NO: 86228 - RNA, 1410 nt, Artificial Sequence
  derived and/or modified sequence opt1 from neuraminidase__InfluenzaA__AHZ35647
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccggacguccgcugcgugugccgggacaacuggaagggcagcaaccgccccaucguggacaucaacaucaaggaccacuccaucgucagcuccuacgugugcagcgggcuggugggcgacaccccgcggaagaacgacuccagcuccagcucccacugccuggaccccaacaacgaggagggcgggcacggcgucaaggggugggccuucgacgacggcaacgacguguggauggggcgcaccaucaacgagacgagccggcucggcuacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcgggcggaaggaggagaccgaggugcucuggaccagcaacuccaucgucguguucugcggcacgagcggcaccuacgggaccggcuccuggcccgacggggccgaccugaaccugaugcccaucuga

SEQ ID NO: 86229 - RNA, 1410 nt, Artificial Sequence; identical to SEQ ID NO: 83930
  derived and/or modified sequence opt1 from neuraminidase__InfluenzaA__AHZ35659

SEQ ID NO: 86230 - RNA, 1410 nt, Artificial Sequence; identical to SEQ ID NO: 83930
  derived and/or modified sequence opt1 from neuraminidase__InfluenzaA__AHZ35671

SEQ ID NO: 86231 - RNA, 1410 nt, Artificial Sequence; identical to SEQ ID NO: 83930
  derived and/or modified sequence opt1 from neuraminidase__InfluenzaA__AHZ35683

SEQ ID NO: 86232 - RNA, 1410 nt, Artificial Sequence
  derived and/or modified sequence opt1 from neuraminidase__InfluenzaA__AHZ35695
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgacaucaccggguucgcgcccuucagcaaggacaacuccauccgccugagcgccggcggggacaucugggucacccgggagccguacguguccugcgaccccgacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgagcggcucguggacagcguggucuccuggagcaaggagauccugcgcacccaggaguccgagugcgugugcaucaacgggacgugcaccguggucaugaccgacggcagcgccuccgggaaggccgacaccaagauccuguucaucgaggagggcaagaucgugcacacgagcacccucagcggcuccgcgcagcacguggaggagugcagcugcuacccgcgguaccccgggguccgcugcgugugccgggacaacuggaagggcuccaaccgccccaucguggacaucaacaucaaggaccacagcaucgucuccagcuacgugugcuccgggcuggugggcgacacgccccggaagaacgacagcuccagcuccagccacugccuggacccgaacaacgaggagggcgggcacggcgucaaggggugggccuucgacgacggcaacgacguguggauggggcgcaccaucaacgagaccucccggcucggcuacgagaccuucaaggucaucgagggcuggagcaaccccaaguccaagcugcagaucaaccgccaggugaucguggaccgcggggaccggagcggcuacuccgggaucuucagcgucgagggcaacuccugcaucaaccggugcuucuacguggagcugauccgcgggcggaaggaggagaccgaggugcucuggaccagcaacagcaucgucguguucugcggcacguccggcaccuacgggaccggcagcuggcccgacggggccgaccugaaccugaugcccaucuga

SEQ ID NO: 86233 - RNA, 1410 nt, Artificial Sequence
  derived and/or modified sequence opt1 from neuraminidase__InfluenzaA__AHZ35719
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugacccccaucuga

SEQ ID NO: 86234 - RNA, 1410 nt, Artificial Sequence; identical to SEQ ID NO: 83930
  derived and/or modified sequence opt1 from neuraminidase__InfluenzaA__AHZ35731

SEQ ID NO: 86235 - RNA, 1410 nt, Artificial Sequence; identical to SEQ ID NO: 83930
  derived and/or modified sequence opt1 from neuraminidase__InfluenzaA__AHZ35743

SEQ ID NO: 86236 - RNA, 1410 nt, Artificial Sequence; identical to SEQ ID NO: 83930
  derived and/or modified sequence opt1 from neuraminidase__InfluenzaA__AHZ35755

SEQ ID NO: 86237 - RNA, 1410 nt, Artificial Sequence; identical to SEQ ID NO: 83930
  derived and/or modified sequence opt1 from neuraminidase__InfluenzaA__AHZ35767

SEQ ID NO: 86238 - RNA, 1410 nt, Artificial Sequence; identical to SEQ ID NO: 83930
  derived and/or modified sequence opt1 from neuraminidase__InfluenzaA__AHZ35779

SEQ ID NO: 86239 - RNA, 1410 nt, Artificial Sequence
  derived and/or modified sequence opt1 from neuraminidase__InfluenzaA__AHZ35803
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaugaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 86240 - RNA, 1410 nt, Artificial Sequence
  derived and/or modified sequence opt1 from neuraminidase__InfluenzaA__AHZ35814
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggaccucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggccggacggcgccgaccucaaccugaugcccaucuga

SEQ ID NO: 86241 - RNA, 1410 nt, Artificial Sequence
  derived and/or modified sequence opt1 from neuraminidase__InfluenzaA__AHZ35837
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 86242 - RNA, 1410 nt, Artificial Sequence; identical to SEQ ID NO: 86241
  derived and/or modified sequence opt1 from neuraminidase__InfluenzaA__AHZ35848

SEQ ID NO: 86243 - RNA, 1410 nt, Artificial Sequence; identical to SEQ ID NO: 86241
  derived and/or modified sequence opt1 from neuraminidase__InfluenzaA__AHZ35859

SEQ ID NO: 86244 - RNA, 1410 nt, Artificial Sequence; identical to SEQ ID NO: 86240
  derived and/or modified sequence opt1 from neuraminidase__InfluenzaA__AHZ35870

SEQ ID NO: 86245 - RNA, 1410 nt, Artificial Sequence; identical to SEQ ID NO: 86240
  derived and/or modified sequence opt1 from neuraminidase__InfluenzaA__AHZ35882

SEQ ID NO: 86246 - RNA, 1410 nt, Artificial Sequence
  derived and/or modified sequence opt1 from neuraminidase__InfluenzaA__AHZ35894
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcagcgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 86247 - RNA, 1410 nt, Artificial Sequence; identical to SEQ ID NO: 86241
  derived and/or modified sequence opt1 from neuraminidase__InfluenzaA__AHZ35905

SEQ ID NO: 86248 - RNA, 1410 nt, Artificial Sequence; identical to SEQ ID NO: 86241
  derived and/or modified sequence opt1 from neuraminidase__InfluenzaA__AHZ35916

SEQ ID NO: 86249 - RNA, 1410 nt, Artificial Sequence; identical to SEQ ID NO: 81966
  derived and/or modified sequence opt1 from neuraminidase__InfluenzaA__AHZ35927

SEQ ID NO: 86250 - RNA, 1410 nt, Artificial Sequence
  derived and/or modified sequence opt1 from neuraminidase__InfluenzaA__AHZ35938
augaaccccaaccagaagaucaucaccaucggcagcgugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 86251 - RNA, 1410 nt, Artificial Sequence; identical to SEQ ID NO: 86240
  derived and/or modified sequence opt1 from neuraminidase__InfluenzaA__AHZ35949

SEQ ID NO: 86252 - RNA, 1410 nt, Artificial Sequence
  derived and/or modified sequence opt1 from neuraminidase__InfluenzaA__AHZ35961
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagagcaccaucuggaccuccgggagcuccaucagcuucugcggcgucaacuccgacaccgugggguggagcuggcccgacggcgccgagcucccguucacgaucgacaaguga

SEQ ID NO: 86253 - RNA, 1410 nt, Artificial Sequence; identical to SEQ ID NO: 86241
  derived and/or modified sequence opt1 from neuraminidase__InfluenzaA__AHZ35972

SEQ ID NO: 86254 - RNA, 1410 nt, Artificial Sequence
  derived and/or modified sequence opt1 from neuraminidase__InfluenzaA__AHZ35983
augaaccccaaccagaagaucaccaccaucggcagcgugugcaugacgaucgggauggccaaccugaugcuccagaucggcaacaucaucuccaucuggaucagccacuccauccagcuggggaacaagaaccagaucgagaccugcaaccagagcgucaucaccuacgagaacaacaccugggugaaccagacguacgugaacaucuccaacaccaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacacgaucaagagcuggcgcaacaacauccugcggacccaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcacggacaacaacuucagcaucaagcaggacaucgucgggaucaacgagugguccggcuacagcggguccuucgugcagcacccggagcucaccggccuggacugcauccgccccugcuucuggguggagcugauccggggccgccccaaggagaacaccaucuggaccagcggguccagcaucuccuucugcggcgucaacagcgacacgguggggugguccuggcccgacggcgccgagcucccguucaccaucgacaaguga

SEQ ID NO: 86255 - RNA, 1410 nt, Artificial Sequence; identical to SEQ ID NO: 86241
  derived and/or modified sequence opt1 from neuraminidase__InfluenzaA__AHZ35994

SEQ ID NO: 86256 - RNA, 1410 nt, Artificial Sequence; identical to SEQ ID NO: 86241
  derived and/or modified sequence opt1 from neuraminidase__InfluenzaA__AHZ36005

SEQ ID NO: 86257 - RNA, 1410 nt, Artificial Sequence; identical to SEQ ID NO: 86241
  derived and/or modified sequence opt1 from neuraminidase__InfluenzaA__AHZ36016

SEQ ID NO: 86258 - RNA, 1410 nt, Artificial Sequence
  derived and/or modified sequence opt1 from neuraminidase__InfluenzaA__AHZ36027
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacggguucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucaucgggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 86259 - RNA, 1410 nt, Artificial Sequence
  derived and/or modified sequence opt1 from neuraminidase__InfluenzaA__AHZ36050
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggcgcaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 86260 - RNA, 1410 nt, Artificial Sequence
  derived and/or modified sequence opt1 from neuraminidase__InfluenzaA__AHZ36062
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucggcugccgcaccuucuuccugacccagggggcccugcucaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcugaccaucggcaucuccgggcccgacaacggcgccguggccguccucaaguacaacgggaucaucaccgacaccaucaagagcuggcgcaacaacauccugcggacgcaggaguccgagugcgcgugcgugaacggcagcugcuucaccaucaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccuggaguaccagaucggcuacaucugcuccgggaucuucggcgacaacccgcggccccacgacaagaccggcagcugcgggcccgucuccagcaacggcgccaacggggugaagggcuucuccuucaaguacgggaacggcguguggaucggccgcaccaagagcaucagcucccggaagggguucgagaugaucugggaccccaacggcuggaccgggaccgacaacaacuucagcaucaagcaggacaucgucggcaucaacgagugguccggguacagcggcuccuucgugcagcacccggagcucacgggccuggacugcauccgccccugcuucuggguggagcugauccgggggcgccccaaggagaacaccaucuggaccagcggcuccagcaucuccuucugcggggucaacagcgacaccgugggcugguccuggcccgacggcgccgagcucccguucacgaucgacaaguga

SEQ ID NO: 86261 - RNA, 1410 nt, Artificial Sequence; identical to SEQ ID NO: 86241
  derived and/or modified sequence opt1 from neuraminidase__InfluenzaA__AHZ36084

SEQ ID NO: 86262 - RNA, 1410 nt, Artificial Sequence
  derived and/or modified sequence opt1 from neuraminidase__InfluenzaA__AHZ36095
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacggguucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcggcugcgggcccgucagcuccaacggcgccaacggggugaagggcuucagcuucaaguacgggaacggcguguggaucggccgcaccaaguccaucagcagccggaagggguucgagaugaucugggaccccaacggcuggaccgggaccgacaacaacuucuccaucaagcaggacaucaucggcaucaacgaguggagcggguacuccggcagcuucguccagcacccggagcugaccggccuggacugcauccgccccugcuucuggguggagcucauccgggggcgccccaaggagaacacgaucuggaccuccggcagcuccaucagcuucugcggggugaacuccgacaccgucggcuggagcuggcccgacggcgccgagcugccguucaccaucgacaaguga

SEQ ID NO: 86263 - RNA, 1410 nt, Artificial Sequence; identical to SEQ ID NO: 86241
  derived and/or modified sequence opt1 from neuraminidase__InfluenzaA__AHZ36106

SEQ ID NO: 86264 - RNA, 1410 nt, Artificial Sequence
  derived and/or modified sequence opt1 from neuraminidase__InfluenzaA__AHZ36117
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacagcaacgggaccaucaaggaccggucccccuaccgcacccugaugagcugcuccaucggcgaggucccgagccccuacaacagccgguucgaguccguggccuggagcgcguccgccugccacgacggguucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggccccagcgacggccaggccuccuacaagaucuuccgcaucgagaaggggaagaucgugaaguccgucgagaugaacgccccgaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccccggccgaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucaucgggaucaacgaguggagcggcuacuccgggagcuucguccagcaccccgagcugaccggccuggacugcauccgcccgugcuucuggguggagcucauccggggccgccccaaggagaacacgaucuggaccuccgggagcuccaucagcuucugcggcgugaacuccgacaccgucggguggagcuggcccgacggcgccgagcugcccuucaccaucgacaaguga

SEQ ID NO: 86265 - RNA, 1410 nt, Artificial Sequence; identical to SEQ ID NO: 86241
  derived and/or modified sequence opt1 from neuraminidase__InfluenzaA__AHZ36128

SEQ ID NO: 86266 - RNA, 1410 nt, Artificial Sequence; identical to SEQ ID NO: 86241
  derived and/or modified sequence opt1 from neuraminidase__InfluenzaA__AHZ36139

SEQ ID NO: 86267 - RNA, 1410 nt, Artificial Sequence; identical to SEQ ID NO: 86259
  derived and/or modified sequence opt1 from neuraminidase__InfluenzaA__AHZ36150

SEQ ID NO: 86268 - RNA, 1410 nt, Artificial Sequence; identical to SEQ ID NO: 86241
  derived and/or modified sequence opt1 from neuraminidase__InfluenzaA__AHZ36161

SEQ ID NO: 86269 - RNA, 1410 nt, Artificial Sequence; identical to SEQ ID NO: 86241
  derived and/or modified sequence opt1 from neuraminidase__InfluenzaA__AHZ36172

SEQ ID NO: 86270 - RNA, 1410 nt, Artificial Sequence
  derived and/or modified sequence opt1 from neuraminidase__InfluenzaA__AHZ36183
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcauccucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86271 - RNA, 1410 nt, Artificial Sequence; identical to SEQ ID NO: 86240
  derived and/or modified sequence opt1 from neuraminidase__InfluenzaA__AHZ36194

SEQ ID NO: 86272 - RNA, 1410 nt, Artificial Sequence; identical to SEQ ID NO: 86259
  derived and/or modified sequence opt1 from neuraminidase__InfluenzaA__AHZ36206

SEQ ID NO: 86273 - RNA, 1410 nt, Artificial Sequence; identical to SEQ ID NO: 86241
  derived and/or modified sequence opt1 from neuraminidase__InfluenzaA__AHZ36218

SEQ ID NO: 86274 - RNA, 1410 nt, Artificial Sequence; identical to SEQ ID NO: 86259
  derived and/or modified sequence opt1 from neuraminidase__InfluenzaA__AHZ36229

SEQ ID NO: 86275 - RNA, 1410 nt, Artificial Sequence; identical to SEQ ID NO: 86241
  derived and/or modified sequence opt1 from neuraminidase__InfluenzaA__AHZ36241

SEQ ID NO: 86276 - RNA, 1410 nt, Artificial Sequence; identical to SEQ ID NO: 86241
  derived and/or modified sequence opt1 from neuraminidase__InfluenzaA__AHZ36252

SEQ ID NO: 86277 - RNA, 1410 nt, Artificial Sequence; identical to SEQ ID NO: 86241
  derived and/or modified sequence opt1 from neuraminidase__InfluenzaA__AHZ36263

SEQ ID NO: 86278 - RNA, 1410 nt, Artificial Sequence; identical to SEQ ID NO: 83930
  derived and/or modified sequence opt1 from neuraminidase__InfluenzaA__AHZ36274

SEQ ID NO: 86279 - RNA, 1410 nt, Artificial Sequence; identical to SEQ ID NO: 86241
  derived and/or modified sequence opt1 from neuraminidase__InfluenzaA__AHZ36286

SEQ ID NO: 86280 - RNA, 1410 nt, Artificial Sequence
  derived and/or modified sequence opt1 from neuraminidase__InfluenzaA__AHZ36297
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugcccccggccggccgaguaccgcaacuggagcaagccccagugcgacaucaccggguucgcgcccuucuccaaggacaacagcauccggcuguccgccggcggggacaucugggucacccgcgagcccuacgugagcugcgacccggacaagugcuaccaguucgcccugggccaggggaccacgcucaacaacgugcacuccaacaacaccguccgggaccgcacccccuaccggacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcgccucguggacuccguggucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggggcgcgcagcacguggaggagugcagcugcuacccccgcuacccggggguccggugcgugugccgcgacaacuggaagggcuccaaccggcccaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaaguccugcaucaaccgcugcuucuacguggagcugauccggggccgcaaggaggagaccgaggugcucuggaccagcaacagcaucgucguguucugcgggacguccggcaccuacgggaccggcagcuggcccgacggggccgaccugaaccugaugcccaucuga

SEQ ID NO: 86281 - RNA, 1410 nt, Artificial Sequence
  derived and/or modified sequence opt1 from neuraminidase__InfluenzaA__AHZ36309
augaaccccaaccagaagaucaucaccaucggcagcgugugcaugaccaucgggauggccaaccugaugcuccagaucggcaacaucaucuccaucuggaucagccacuccauccagcugggggacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 86282 - RNA, 1410 nt, Artificial Sequence; identical to SEQ ID NO: 86241
  derived and/or modified sequence opt1 from neuraminidase__InfluenzaA__AHZ36320

SEQ ID NO: 86283 - RNA, 1410 nt, Artificial Sequence; identical to SEQ ID NO: 86241
  derived and/or modified sequence opt1 from neuraminidase__InfluenzaA__AHZ36331

SEQ ID NO: 86284 - RNA, 1410 nt, Artificial Sequence; identical to SEQ ID NO: 83930
  derived and/or modified sequence opt1 from neuraminidase__InfluenzaA__AHZ36353

SEQ ID NO: 86285 - RNA, 1410 nt, Artificial Sequence
  derived and/or modified sequence opt1 from neuraminidase__InfluenzaA__AHZ36365
augaaccccaaccagaagaucaucaccaucggcagcgugugcaugaccaucgggauggccaaccugaugcuccagaucggcaacaucaucuccaucuggaucagccacccgauccagcuggggaacaagaaccagaucgagacgugcaaccaguccgucaucaccuacgagaacaacaccugggugaaccagaccuacgugaacaucagcaacacgaacuucgccgcgggccaguccgucgugagcgugaagaucgccgggaacuccagccugugccccgucuccggcugggccaucuacagcaaggacaacuccauccgcaucggcagcaagggggacguguucgugauccgggagcccuucaucuccugcagcccccucgagugccgcaccuucuuccugacccagggcgcccugcucaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcugaccaucggcaucagcggcccggacaacggggccguggccguccucaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccguggguguccuucaaccagaaccuggaguaccagaucggguacaucugcagcggcaucuucggggacaacccccggccccacgacaagaccggcuccugcggccccgucagcuccaacggggccaacggcgugaagggguucagcuucaaguacggcaacgggguguggaucggccgcaccaaguccaucagcagccggaagggcuucgagaugaucugggacccgaacggguggaccggcaccgacaacaacuucuccaucaagcaggacaucgucgggaucaacgaguggagcggcuacuccgggagcuucgugcagcaccccgagcucacgggccuggacugcauccgccccugcuucuggguggagcugauccggggccgccccaaggagaacaccaucuggaccuccgggagcuccaucagcuucugcggcgucaacuccgacaccgugggguggagcuggccggacggcgccgagcuccccuucacgaucgacaaguga

SEQ ID NO: 86286 - RNA, 1410 nt, Artificial Sequence; identical to SEQ ID NO: 83930
  derived and/or modified sequence opt1 from neuraminidase__InfluenzaA__AHZ36376

SEQ ID NO: 86287 - RNA, 1410 nt, Artificial Sequence; identical to SEQ ID NO: 83930
  derived and/or modified sequence opt1 from neuraminidase__InfluenzaA__AHZ36388

SEQ ID NO: 86288 - RNA, 1410 nt, Artificial Sequence; identical to SEQ ID NO: 83930
  derived and/or modified sequence opt1 from neuraminidase__InfluenzaA__AHZ36400

SEQ ID NO: 86289 - RNA, 1410 nt, Artificial Sequence; identical to SEQ ID NO: 83930
  derived and/or modified sequence opt1 from neuraminidase__InfluenzaA__AHZ36412

SEQ ID NO: 86290 - RNA, 1410 nt, Artificial Sequence; identical to SEQ ID NO: 83930
  derived and/or modified sequence opt1 from neuraminidase__InfluenzaA__AHZ36424

SEQ ID NO: 86291 - RNA, 1410 nt, Artificial Sequence; identical to SEQ ID NO: 83930
  derived and/or modified sequence opt1 from neuraminidase__InfluenzaA__AHZ36436

SEQ ID NO: 86292 - RNA, 1410 nt, Artificial Sequence
  derived and/or modified sequence opt1 from neuraminidase__InfluenzaA__AHZ36448
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagccggccgaguaccgcaacuggagcaagccccagugcgacaucaccggguucgcgcccuucuccaaggacaacagcauccggcuguccgccggcggggacaucugggucacccgcgagcccuacgugagcugcgacccggacaagugcuaccaguucgcccugggccaggggaccacgcucaacaacgugcacuccaacaacaccguccgggaccgcacccccuaccggacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcgccucguggacuccguggucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86293 - RNA, 1410 nt, Artificial Sequence; identical to SEQ ID NO: 83930
  derived and/or modified sequence opt1 from neuraminidase__InfluenzaA__AHZ36460

SEQ ID NO: 86294 - RNA, 1410 nt, Artificial Sequence; identical to SEQ ID NO: 83930
  derived and/or modified sequence opt1 from neuraminidase__InfluenzaA__AHZ36472

SEQ ID NO: 86295 - RNA, 1410 nt, Artificial Sequence; identical to SEQ ID NO: 83930
  derived and/or modified sequence opt1 from neuraminidase__InfluenzaA__AHZ36484

SEQ ID NO: 86296 - RNA, 1410 nt, Artificial Sequence; identical to SEQ ID NO: 83930
  derived and/or modified sequence opt1 from neuraminidase__InfluenzaA__AHZ36496

SEQ ID NO: 86297 - RNA, 1410 nt, Artificial Sequence; identical to SEQ ID NO: 83930
  derived and/or modified sequence opt1 from neuraminidase__InfluenzaA__AHZ36508

SEQ ID NO: 86298 - RNA, 1410 nt, Artificial Sequence; identical to SEQ ID NO: 83930
  derived and/or modified sequence opt1 from neuraminidase__InfluenzaA__AHZ36520

SEQ ID NO: 86299 - RNA, 1410 nt, Artificial Sequence
  derived and/or modified sequence opt1 from neuraminidase__InfluenzaA__AHZ36532
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaccuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcacgaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggcccgacggcgccgaccugaaccugaugcccaucuga

SEQ ID NO: 86300 - RNA, 1410 nt, Artificial Sequence; identical to SEQ ID NO: 83930
  derived and/or modified sequence opt1 from neuraminidase__InfluenzaA__AHZ36544

SEQ ID NO: 86301 - RNA, 1410 nt, Artificial Sequence; identical to SEQ ID NO: 83930
  derived and/or modified sequence opt1 from neuraminidase__InfluenzaA__AHZ36556

SEQ ID NO: 86302 - RNA, 1410 nt, Artificial Sequence; identical to SEQ ID NO: 83930
  derived and/or modified sequence opt1 from neuraminidase__InfluenzaA__AHZ36568

SEQ ID NO: 86303 - RNA, 1410 nt, Artificial Sequence; identical to SEQ ID NO: 83930
  derived and/or modified sequence opt1 from neuraminidase__InfluenzaA__AHZ36580

SEQ ID NO: 86304 - RNA, 1410 nt, Artificial Sequence; identical to SEQ ID NO: 83930
  derived and/or modified sequence opt1 from neuraminidase__InfluenzaA__AHZ36592

SEQ ID NO: 86305 - RNA, 1410 nt, Artificial Sequence; identical to SEQ ID NO: 83930
  derived and/or modified sequence opt1 from neuraminidase__InfluenzaA__AHZ36604

SEQ ID NO: 86306 - RNA, 1410 nt, Artificial Sequence; identical to SEQ ID NO: 83930
  derived and/or modified sequence opt1 from neuraminidase__InfluenzaA__AHZ36616

SEQ ID NO: 86307 - RNA, 1410 nt, Artificial Sequence
  derived and/or modified sequence opt1 from neuraminidase__InfluenzaA__AHZ36628
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86308 - RNA, 1410 nt, Artificial Sequence
  derived and/or modified sequence opt1 from neuraminidase__InfluenzaA__AHZ36640
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccacgaccgcacccccuaccggacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcgccucguggacuccguggucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86309 - RNA, 1410 nt, Artificial Sequence; identical to SEQ ID NO: 83930
  derived and/or modified sequence opt1 from neuraminidase__InfluenzaA__AHZ36652

SEQ ID NO: 86310 - RNA, 1410 nt, Artificial Sequence; identical to SEQ ID NO: 83154
  derived and/or modified sequence opt1 from neuraminidase__InfluenzaA__AHZ36664

SEQ ID NO: 86311 - RNA, 1410 nt, Artificial Sequence; identical to SEQ ID NO: 83154
  derived and/or modified sequence opt1 from neuraminidase__InfluenzaA__AHZ36676

SEQ ID NO: 86312 - RNA, 1410 nt, Artificial Sequence; identical to SEQ ID NO: 83154
  derived and/or modified sequence opt1 from neuraminidase__InfluenzaA__AHZ36688

SEQ ID NO: 86313 - RNA, 1398 nt, Artificial Sequence; identical to SEQ ID NO: 84462
  derived and/or modified sequence opt1 from neuraminidase__InfluenzaA__AHZ39689

SEQ ID NO: 86314 - RNA, 1398 nt, Artificial Sequence; identical to SEQ ID NO: 84462
  derived and/or modified sequence opt1 from neuraminidase__InfluenzaA__AHZ39713

SEQ ID NO: 86315 - RNA, 1398 nt, Artificial Sequence; identical to SEQ ID NO: 84462
  derived and/or modified sequence opt1 from neuraminidase__InfluenzaA__AHZ39725

SEQ ID NO: 86316 - RNA, 1398 nt, Artificial Sequence; identical to SEQ ID NO: 84462
  derived and/or modified sequence opt1 from neuraminidase__InfluenzaA__AHZ39737

SEQ ID NO: 86317 - RNA, 1398 nt, Artificial Sequence
  derived and/or modified sequence opt1 from neuraminidase__InfluenzaA__AHZ39749
augaaccccaaccagaagauccugugcaucagcgccaccgccaucaucaucggcgcgaucgccgugcucaucgggaucgccaaccugggccugaacaucgggcuccaccugaagccgggcugcaacugcucccacagccagcccgagaccacgaacaccucccagaccaucaucaacaacuacuacaacgagaccaacaucacgaacauccagauggaggagcgcaccagccggaacuucaacaaccugaccaaggggcucugcaccaucaacuccuggcacaucuacggcaaggacaacgccguccgcaucggcgagagcuccgacgugcuggugacgcgggagcccuacgucagcugcgaccccgacgagugccgcuucuacgcccugucccaggggaccaccauccggggcaagcacagcaacgggaccauccacgaccgcucccaguaccgggcgcucaucagcuggccgcuguccagcccgcccacgguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacccaggagagcgagugcgucugccacaacggcgugugccccguggucuucacggacggguccgccaccggccccgccgacacccgcaucuacuacuucaaggaggggaagauccucaagugggagagccugaccggcacggccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagaccaucguccugaacgccgacuggagcggcuacuccgggagcuucauggacuacugggccgagggcgacugcuaccgcgcgugcuucuacguggagcugauccgcggccggcccaaggaggacaaggugugguggacguccaacagcaucgucuccaugugcagcagcaccgaguuccucgggcaguggaacuggcccgacggcgccaagaucgaguacuuccuguga

SEQ ID NO: 86318 - RNA, 1398 nt, Artificial Sequence; identical to SEQ ID NO: 86317
  derived and/or modified sequence opt1 from neuraminidase__InfluenzaA__AHZ39761

SEQ ID NO: 86319 - RNA, 1398 nt, Artificial Sequence; identical to SEQ ID NO: 84462
  derived and/or modified sequence opt1 from neuraminidase__InfluenzaA__AHZ39773

SEQ ID NO: 86320 - RNA, 1398 nt, Artificial Sequence; identical to SEQ ID NO: 84462
  derived and/or modified sequence opt1 from neuraminidase__InfluenzaA__AHZ39785

SEQ ID NO: 86321 - RNA, 1410 nt, Artificial Sequence
  derived and/or modified sequence opt1 from neuraminidase__InfluenzaA__AHZ39797
augaaccccaaccagaagaucaucaccaucggcagcgugucccugaccaucagcacggucugcuucuucaugcagaucgccauccucaucaccaccgugacccugcacuucaagcaguacgaguucaacccgccgcccaacaaccaggugaugcugugcgagcccacgaucaucgagcgcaacaucaccgagaucgucuaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggugacccgggagccguacguguccugcgaccccgacaagugcuaccaguucgcccuggggcagggcaccacgcucaacaacguccacagcaacaacaccgugcgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcgucguguccuggagcaaggagauccugcgcacccaggaguccgagugcgugugcaucaacgggacgugcaccgucgugaugaccgacggcagcgccuccggcaagagcgacaccaagauccuguucaucgaggaggggaagaucgugcacacgagcacccucuccggcagcgcccagcacgucgaggagugcuccugcuacccgcgguaccccggggugcgcugcgugugccgggacaacuggaagggcagcaaccgccccaucgucgacaucaacaucaaggaccacuccaucgugagcuccuacgugugcagcggccuggucggggacacgccccggaagaacgacuccagcuccagcucccacugccuggacccgaacaacgaggagggcgggcacggcgugaaggggugggcguucgacgacggcaacgacgucuggaugggccgcaccaucaacgagaccagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86322 - RNA, 1410 nt, Artificial Sequence
  derived and/or modified sequence opt1 from neuraminidase__InfluenzaA__AHZ39821
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggcgcaacgacuccagcuccagcucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgaccugaaccucaugcccacguga

SEQ ID NO: 86323 - RNA, 1410 nt, Artificial Sequence; identical to SEQ ID NO: 84397
  derived and/or modified sequence opt1 from neuraminidase__InfluenzaA__AHZ39833

SEQ ID NO: 86324 - RNA, 1410 nt, Artificial Sequence; identical to SEQ ID NO: 83154
  derived and/or modified sequence opt1 from neuraminidase__InfluenzaA__AHZ39844

SEQ ID NO: 86325 - RNA, 1410 nt, Artificial Sequence
  derived and/or modified sequence opt1 from neuraminidase__InfluenzaA__AHZ39856
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcccaucaaccgccaggugaucguggaccggggcgaccggagcggguacuccggcaucuucagcgucgaggggaaguccugcaucaaccgcugcuucuacguggagcugauccggggccgcaaggaggagaccgaggugcucuggaccagcaacagcaucgucguguucugcggcacguccgggaccuacggcaccgggagcuggcccgacggcgccgaccugaaccugaugcccaucuga

SEQ ID NO: 86326 - RNA, 1410 nt, Artificial Sequence; identical to SEQ ID NO: 83154
  derived and/or modified sequence opt1 from neuraminidase__InfluenzaA__AHZ39868

SEQ ID NO: 86327 - RNA, 1410 nt, Artificial Sequence
  derived and/or modified sequence opt1 from neuraminidase__InfluenzaA__AHZ39892
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagccgguacgugugcuccggccuggucggcgacacgccccgcaagaacgacagcuccagcuccagccacugccuggaccccaacaacgaggagggcgggcacggggugaagggcugggccuucgacgacgggaacgacgucuggaugggccggaccaucaacgagaccucccgccucggcuacgagaccuucaaggugaucgagggguggagcaacccgaaguccaagcugcagaucaaccgccaggugaucgucgaccggggcgaccggagcggguacuccggcaucuucagcguggaggggaaguccugcaucaaccgcugcuucuacguggagcugauccggggccgcaaggaggagaccgagguccucuggaccagcaacagcaucgugguguucugcggcacguccgggaccuacggcaccgggagcuggcccgacggcgccgaccugaaccugaugcccaucuga

SEQ ID NO: 86328 - RNA, 1410 nt, Artificial Sequence; identical to SEQ ID NO: 84362
  derived and/or modified sequence opt1 from neuraminidase__InfluenzaA__AHZ39904

SEQ ID NO: 86329 - RNA, 1410 nt, Artificial Sequence; identical to SEQ ID NO: 84362
  derived and/or modified sequence opt1 from neuraminidase__InfluenzaA__AHZ39916

SEQ ID NO: 86330 - RNA, 1410 nt, Artificial Sequence; identical to SEQ ID NO: 83154
  derived and/or modified sequence opt1 from neuraminidase__InfluenzaA__AHZ39928

SEQ ID NO: 86331 - RNA, 1410 nt, Artificial Sequence
  derived and/or modified sequence opt1 from neuraminidase__InfluenzaA__AHZ39940
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaccgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86332 - RNA, 1410 nt, Artificial Sequence; identical to SEQ ID NO: 83154
  derived and/or modified sequence opt1 from neuraminidase__InfluenzaA__AHZ39952

SEQ ID NO: 86333 - RNA, 1410 nt, Artificial Sequence; identical to SEQ ID NO: 83154
  derived and/or modified sequence opt1 from neuraminidase__InfluenzaA__AHZ39976

SEQ ID NO: 86334 - RNA, 1410 nt, Artificial Sequence
  derived and/or modified sequence opt1 from neuraminidase__InfluenzaA__AHZ39988
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcacccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggcguucgacgacggcaacgacgucuggaugggccgcacgaucaacgagaccagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucuga

SEQ ID NO: 86335 - RNA, 1410 nt, Artificial Sequence; identical to SEQ ID NO: 83154
  derived and/or modified sequence opt1 from neuraminidase__InfluenzaA__AHZ40000

SEQ ID NO: 86336 - RNA, 1410 nt, Artificial Sequence; identical to SEQ ID NO: 83154
  derived and/or modified sequence opt1 from neuraminidase__InfluenzaA__AHZ40012

SEQ ID NO: 86337 - RNA, 1410 nt, Artificial Sequence
  derived and/or modified sequence opt1 from neuraminidase__InfluenzaA__AHZ40024
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguucgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86338 - RNA, 1410 nt, Artificial Sequence; identical to SEQ ID NO: 83154
  derived and/or modified sequence opt1 from neuraminidase__InfluenzaA__AHZ40036

SEQ ID NO: 86339 - RNA, 1410 nt, Artificial Sequence; identical to SEQ ID NO: 84365
  derived and/or modified sequence opt1 from neuraminidase__InfluenzaA__AHZ40048

SEQ ID NO: 86340 - RNA, 1410 nt, Artificial Sequence; identical to SEQ ID NO: 83154
  derived and/or modified sequence opt1 from neuraminidase__InfluenzaA__AHZ40063

SEQ ID NO: 86341 - RNA, 1410 nt, Artificial Sequence
  derived and/or modified sequence opt1 from neuraminidase__InfluenzaA__AHZ40075
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacacgccccggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagaccuucaaggugaucgagggcugguccaacagcaaguccaagcugcagaucaaccgccaggugaucgucgaccgcggggaccggagcggcuacuccgggaucuucagcguggagggcaagagcugcaucaaccggugcuucuacguggagcugauccgcggccggaaggaggagaccgagguccucuggaccuccaacagcaucgugguguucugcgggacguccggcaccuacgggaccggcagcuggccggacggggccgaccugaaccugaugcccaucuga

SEQ ID NO: 86342 - RNA, 1410 nt, Artificial Sequence; identical to SEQ ID NO: 83154
  derived and/or modified sequence opt1 from neuraminidase__InfluenzaA__AHZ40087

SEQ ID NO: 86343 - RNA, 1410 nt, Artificial Sequence; identical to SEQ ID NO: 84365
  derived and/or modified sequence opt1 from neuraminidase__InfluenzaA__AHZ40099

SEQ ID NO: 86344 - RNA, 1410 nt, Artificial Sequence
  derived and/or modified sequence opt1 from neuraminidase__InfluenzaA__AHZ40111
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugcccgaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggacauccugcgcacccaggaguccgagugcgugugcaucaacggcacgugcgccguggucaugaccgacgggagcgccuccggcaaggcggacaccaagauccucuucaucgaggagggcaagaucgugcacaccagcacgcugagcggguccgcccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccgggcacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagagcaagcugcagaucaaccgccaggugaucguggaccgggggaaccgcuccggcuacagcgggaucuucuccgucgagggcaagaacugcaucaaccggugcuucuacguggagcucauccgcggccggaaggaggagaccgaggugcuguggaccagcaacuccaucgucguguucugcgggaccagcggcacguacgggaccggcagcuggcccgacggggccgaccugaaccucaugcccaucuga

SEQ ID NO: 86345 - RNA, 1410 nt, Artificial Sequence
  derived and/or modified sequence opt1 from neuraminidase__InfluenzaA__AHZ40123
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaccgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacacccggacccucagcggcuccgcgcagcacguggaggagugcagcugcuacccccgcuacccggggguccggugcgugugccgcgacaacuggaagggcuccaaccggcccaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaaguccugcaucaaccgcugcuucuacguggagcugauccggggccgcaaggaggagaccgaggugcucuggacgagcaacagcaucgucguguucugcgggaccuccggcaccuacgggaccggcagcuggcccgacggggccgaccugaaccugaugcccaucuga

SEQ ID NO: 86346 - RNA, 1410 nt, Artificial Sequence; identical to SEQ ID NO: 83154
  derived and/or modified sequence opt1 from neuraminidase__InfluenzaA__AHZ40133

SEQ ID NO: 86347 - RNA, 1410 nt, Artificial Sequence; identical to SEQ ID NO: 84372
  derived and/or modified sequence opt1 from neuraminidase__InfluenzaA__AHZ40145

SEQ ID NO: 86348 - RNA, 1410 nt, Artificial Sequence
  derived and/or modified sequence opt1 from neuraminidase__InfluenzaA__AHZ40157
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcauggccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccucgugggcgacacgccccgcaagaccgacuccagcuccagcucccacugccuggaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcuccagaucaaccgccaggugaucguggaccggggcgaccgguccggguacagcggcaucuucuccgucgagggcaagagcugcaucaaccgcugcuucuacguggagcugauccgggggcgcaaggaggagaccgccgugcuguggacgagcaacuccaucgucguguucugcggcaccagcgggaccuacggcaccggguccuggccggacggcgccgaccucaaccugaugcccaucuga

SEQ ID NO: 86349 - RNA, 1410 nt, Artificial Sequence
  derived and/or modified sequence opt1 from neuraminidase__InfluenzaA__AHZ40169
augaaccccaaccagaagaucaucaccaucggcagcgugugcaugaccaucgggauggccaaccugauccuccagaucggcaacaucaucuccaucuggaucagccacuccauccagcuggagaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccgugcgcaucggcagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccguggccuggagcgcguccgccugccacgacggcaucaacuggcucaccaucgggaucagcggccccgacuccggcgccgucgccgugcugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucagcuucaaguacgggaacggcgucuggaucgggcgcaccaaguccaucagcucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 86350 - RNA, 1410 nt, Artificial Sequence
  derived and/or modified sequence opt1 from neuraminidase__InfluenzaA__AHZ40180
augaaccccaaccagaagaucaucaccaucggcagcgugucccugaccaucagcacgaucugcuucuucaugcagaucaccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcccccuucuccaaggacaacagcauccgccuguccgccgggggcgacaucugggucacccgggagcccuacgugagcugcgacccggacaagugcuaccaguucgcgcuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgccaccgcgagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggcguucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86351 - RNA, 1410 nt, Artificial Sequence; identical to SEQ ID NO: 84018
  derived and/or modified sequence opt1 from neuraminidase__InfluenzaA__AHZ40192

SEQ ID NO: 86352 - RNA, 1410 nt, Artificial Sequence; identical to SEQ ID NO: 83154
  derived and/or modified sequence opt1 from neuraminidase__InfluenzaA__AHZ40204

SEQ ID NO: 86353 - RNA, 1410 nt, Artificial Sequence; identical to SEQ ID NO: 83154
  derived and/or modified sequence opt1 from neuraminidase__InfluenzaA__AHZ40216

SEQ ID NO: 86354 - RNA, 1410 nt, Artificial Sequence; identical to SEQ ID NO: 84383
  derived and/or modified sequence opt1 from neuraminidase__InfluenzaA__AHZ40228

SEQ ID NO: 86355 - RNA, 1410 nt, Artificial Sequence
  derived and/or modified sequence opt1 from neuraminidase__InfluenzaA__AHZ40240
augaaccccaaccagaagaucaucaccaucggcagcgugucccugaccaucagcacgaucugcuuccucaugcagaucgccauccugaucaccaccgccacccugcacuucaagcaguacgaguucaacuccccgcccaacaaccaggucaugcucugcgagcccacgaucaucgagcgcaacaucaccgagaucguguaccugaccaacaccacgaucgagaaggagaucugccccaagccggcggaguaccggaacuggagcaagccccagugcgggaucaccggcuucgcccccuucuccaaggacaacagcauccgccuguccgccgggggcgacaucugggugacccgggagcccuacgucagcugcgacccggacaagugcuaccaguucgcccucgggcagggcaccacgcugaacaacgugcacuccaacaacaccgugcgcgaccggacccccuaccgcacccugcucaugaacgagcugggcguccccuuccaccuggggacgaagcaggucugcaucgccuggagcuccagcuccugccacgacggcaaggcguggcuccacgugugcaucaccggggacgacaagaacgccaccgccagcuucaucuacaacggccggcugguggacuccguggugagcugguccaaggagauccugcgcacccaggagagcgagugcgucugcaucaacgggacgugcaccguggugaugaccgacggcuccgccagcggcaaggcggacaccaagauccucuucaucgaggaggggaagaucguccacacgagcacccuguccggcagcgcccagcacguggaggagugcuccugcuacccccgguacccgggggugcgcugcgucugccgggacaacuggaagggcagcaaccgccccaucguggacaucaacaucaaggaccgguccaucgugagcuccuacgucugcagcggccuggugggggacaccccgcgcaagaacgacuccagcuccagcucccacugccucgaccccaacaacgaggagggcgggcacggcgugaaggggugggccuucgacgacggcaacgacgucuggaugggccggaccaucaacgagacgagccgccugggguacgagaccuucaaggugaucgagggcugguccaaccccaagagcaagcugcagaucaaccggcaggucaucguggaccgcggggaccgguccggcuacagcgggaucuucuccguggagggcaagagcugcaucaaccgcugcuucuacgucgagcucauccggggccgcaaggaggagaccgaggugcuguggaccagcaacuccaucguggucuucugcgggacgagcggcaccuacgggaccggcuccuggcccgacggggccgaccugaaccucaugcccaucuga

SEQ ID NO: 86356 - RNA, 1410 nt, Artificial Sequence
  derived and/or modified sequence opt1 from neuraminidase__InfluenzaA__AHZ40252
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggaggacaagaacgcgaccgccagcuucaucuacaacggccggcucguggacuccaucgugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86357 - RNA, 1410 nt, Artificial Sequence; identical to SEQ ID NO: 86102
  derived and/or modified sequence opt1 from neuraminidase__InfluenzaA__AHZ40264

SEQ ID NO: 86358 - RNA, 1410 nt, Artificial Sequence; identical to SEQ ID NO: 83154
  derived and/or modified sequence opt1 from neuraminidase__InfluenzaA__AHZ40276

SEQ ID NO: 86359 - RNA, 1410 nt, Artificial Sequence
  derived and/or modified sequence opt1 from neuraminidase__InfluenzaA__AHZ40288
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgugaucagcugguccaaggacauccugcgcacccaggagagcgagugcgucugcaucaacggcacgugcgccguggugaugaccgacggguccgccagcggcaaggcggacaccaagauccucuucaucgaggagggcaagaucguccacaccagcacgcuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggagcaaccccaaguccaagcugcagaucaaccgccaggucaucguggaccgggggaaccgcagcggcuacuccgggaucuucagcguggagggcaagaacugcaucaaccggugcuucuacgucgagcucauccgcggccggaaggaggagaccgaggugcuguggaccuccaacagcaucguggucuucugcgggaccagcggcacguacgggaccggcuccuggccggacggggccgaccugaaccucaugcccaucuga

SEQ ID NO: 86360 - RNA, 1410 nt, Artificial Sequence
  derived and/or modified sequence opt1 from neuraminidase__InfluenzaA__AHZ40312
augaaccccaaccagaagaucaucaccaucggcagcgugucccugaccaucagcacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccccgguacccggggguccgcugcgugugccgggacaacuggaagggcuccaaccgccccaucguggacaucaacaucaaggaccacagcgucguguccagcuacgugugcuccggccuggucggggacacgccccggaagaacgacagcuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcggccggaaggaggagaccgagguccucuggaccagcaacagcaucgugguguucugcgggacguccggcaccuacgggaccggcagcuggcccgacggggccgaccugaaccugaugcccaucuga

SEQ ID NO: 86361 - RNA, 1410 nt, Artificial Sequence; identical to SEQ ID NO: 83154
  derived and/or modified sequence opt1 from neuraminidase__InfluenzaA__AHZ40324

SEQ ID NO: 86362 - RNA, 1410 nt, Artificial Sequence; identical to SEQ ID NO: 83154
  derived and/or modified sequence opt1 from neuraminidase__InfluenzaA__AHZ40336

SEQ ID NO: 86363 - RNA, 1410 nt, Artificial Sequence; identical to SEQ ID NO: 86337
  derived and/or modified sequence opt1 from neuraminidase__InfluenzaA__AHZ40348

SEQ ID NO: 86364 - RNA, 1410 nt, Artificial Sequence; identical to SEQ ID NO: 84362
  derived and/or modified sequence opt1 from neuraminidase__InfluenzaA__AHZ40360

SEQ ID NO: 86365 - RNA, 1410 nt, Artificial Sequence
  derived and/or modified sequence opt1 from neuraminidase__InfluenzaA__AHZ40372
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgaccacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86366 - RNA, 1410 nt, Artificial Sequence; identical to SEQ ID NO: 84018
  derived and/or modified sequence opt1 from neuraminidase__InfluenzaA__AHZ40384

SEQ ID NO: 86367 - RNA, 1410 nt, Artificial Sequence; identical to SEQ ID NO: 83154
  derived and/or modified sequence opt1 from neuraminidase__InfluenzaA__AHZ40396

SEQ ID NO: 86368 - RNA, 1410 nt, Artificial Sequence; identical to SEQ ID NO: 83154
  derived and/or modified sequence opt1 from neuraminidase__InfluenzaA__AHZ40408

SEQ ID NO: 86369 - RNA, 1410 nt, Artificial Sequence; identical to SEQ ID NO: 83154
  derived and/or modified sequence opt1 from neuraminidase__InfluenzaA__AHZ40420

SEQ ID NO: 86370 - RNA, 1410 nt, Artificial Sequence
  derived and/or modified sequence opt1 from neuraminidase__InfluenzaA__AHZ40432
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucaucgacaucaacaucaaggaccacuccaucgugagccgguacgucugcuccggccuggugggcgacacgccccgcaagaacgacagcuccagcuccagccacugccuggaccccaacaacgaggagggcgggcacggggugaagggcugggccuucgacgacgggaacgacgucuggaugggccggaccaucaacgagaccucccgccucggcuacgagaccuucaaggugaucgagggguggagcaacccgaaguccaagcugcagaucaaccggcaggucaucguggaccgcggcgaccggagcggguacuccggcaucuucagcguggaggggaaguccugcaucaaccgcugcuucuacgucgagcugauccggggccgcaaggaggagaccgaggugcucuggaccagcaacagcaucguggucuucugcggcacguccgggaccuacggcaccgggagcuggcccgacggcgccgaccugaaccugaugcccaucuga

SEQ ID NO: 86371 - RNA, 1410 nt, Artificial Sequence; identical to SEQ ID NO: 83154
  derived and/or modified sequence opt1 from neuraminidase__InfluenzaA__AHZ40444

SEQ ID NO: 86372 - RNA, 1410 nt, Artificial Sequence
  derived and/or modified sequence opt1 from neuraminidase__InfluenzaA__AHZ40456
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 86373 - RNA, 1410 nt, Artificial Sequence
  derived and/or modified sequence opt1 from neuraminidase__InfluenzaA__AHZ40468
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccgggaacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86374 - RNA, 1410 nt, Artificial Sequence; identical to SEQ ID NO: 84362
  derived and/or modified sequence opt1 from neuraminidase__InfluenzaA__AHZ40480

SEQ ID NO: 86375 - RNA, 1410 nt, Artificial Sequence; identical to SEQ ID NO: 85800
  derived and/or modified sequence opt1 from neuraminidase__InfluenzaA__AHZ40492

SEQ ID NO: 86376 - RNA, 1410 nt, Artificial Sequence; identical to SEQ ID NO: 83154
  derived and/or modified sequence opt1 from neuraminidase__InfluenzaA__AHZ40503

SEQ ID NO: 86377 - RNA, 1410 nt, Artificial Sequence; identical to SEQ ID NO: 83154
  derived and/or modified sequence opt1 from neuraminidase__InfluenzaA__AHZ40515

SEQ ID NO: 86378 - RNA, 1410 nt, Artificial Sequence
  derived and/or modified sequence opt1 from neuraminidase__InfluenzaA__AHZ40527
augaaccccaaccagaagaucaucaccaucggcagcgugucccugaccaucagcacgaugugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86379 - RNA, 1410 nt, Artificial Sequence
  derived and/or modified sequence opt1 from neuraminidase__InfluenzaA__AHZ40539
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugaacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86380 - RNA, 1410 nt, Artificial Sequence; identical to SEQ ID NO: 83154
  derived and/or modified sequence opt1 from neuraminidase__InfluenzaA__AHZ40551

SEQ ID NO: 86381 - RNA, 1410 nt, Artificial Sequence
  derived and/or modified sequence opt1 from neuraminidase__InfluenzaA__AHZ40563
augaaccccaaccagaagaucaucaccaucggcagcgugucccugaccaucagcacggucugcuucuucaugcagaucgccauccucaucaccaccgugacccugcacuucaagcaguacgaguucaacuccagcccgaacaaccaggugaugcugugcgagcccacgaucaucgagcgcaacaucaccgagaucgucuaccucaccaacaccacgaucgagaaggagaucugccccaagcccgccgaguaccggaacugguccaagccgcagugcgggaucaccggcuucgcgcccuucagcaaggacaacuccauccgccugagcgccgggggcgacaucugggugacccgggagcccuacguguccugcgaccccgacaagugcuaccaguucgcccuggggcagggcaccacgcucaacaacguccacagcaacaacaccgugcgcgaccggaccccguaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcgucguguccuggagcaaggagauccugcgcacccaggaguccgagugcgugugcaucaacgggacgugcaccgucgugaugaccgacggcagcgccagcggcaaggccgacaccaagauccuguucaucgaggaggggaagaucgugcacacguccacccucagcggcuccgcgcagcacgucgaggagugcagcugcuacccccgguaccccggggugcgcugcgugugccgggacaacuggaagggcuccaaccgcccgaucgucgacaucaacaucaaggaccacagcaucguguccagcuacgugugcuccggccuggucggggacacgccccggaagaacgacagcuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacuccaagagcaagcugcagaucaaccgccaggugaucgucgaccgcggggaccgguccggcuacagcgggaucuucagcguggagggcaaguccugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugccgaucuga

SEQ ID NO: 86382 - RNA, 1410 nt, Artificial Sequence
  derived and/or modified sequence opt1 from neuraminidase__InfluenzaA__AHZ40575
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucucccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggcccgacggggccgaccugaaccugaugcccaucuga

SEQ ID NO: 86383 - RNA, 1410 nt, Artificial Sequence; identical to SEQ ID NO: 86101
  derived and/or modified sequence opt1 from neuraminidase__InfluenzaA__AHZ40586

SEQ ID NO: 86384 - RNA, 1410 nt, Artificial Sequence
  derived and/or modified sequence opt1 from neuraminidase__InfluenzaA__AHZ40598
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacagcucccugugccccgugagcggcugggccaucuacuccaaggacaacagcgugcgcaucggcuccaagggggacgucuucgugauccgggagcccuucaucagcugcagcccccucgagugccgcaccuucuuccugacccagggcgcccugcucaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcugaccaucggcaucuccggcccggacagcggggccguggccgugcucaaguacaacggcaucaucaccgacaccaucaaguccuggcgcaacgacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccuggaguaccagaucggguacaucugcagcggcaucuucggggacaacccccggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggacccgaacggguggaccggcaccgacaacaacuucuccaucaagcaggacaucguggggaucaacgaguggagcggcuacuccgggagcuucguccagcaccccgagcucacgggccuggacugcauccgccccugcuucuggguggagcugauccggggccgccccaaggagaacaccaucuggaccuccgggagcuccaucagcuucugcggcgucaacuccgacaccgugggguggagcuggccggacggcgccgagcuccccuucacgaucgacaaguga

SEQ ID NO: 86385 - RNA, 1410 nt, Artificial Sequence; identical to SEQ ID NO: 83154
  derived and/or modified sequence opt1 from neuraminidase__InfluenzaA__AHZ40609

SEQ ID NO: 86386 - RNA, 1410 nt, Artificial Sequence; identical to SEQ ID NO: 84383
  derived and/or modified sequence opt1 from neuraminidase__InfluenzaA__AHZ40629

SEQ ID NO: 86387 - RNA, 1410 nt, Artificial Sequence; identical to SEQ ID NO: 84365
  derived and/or modified sequence opt1 from neuraminidase__InfluenzaA__AHZ40641

SEQ ID NO: 86388 - RNA, 1410 nt, Artificial Sequence
  derived and/or modified sequence opt1 from neuraminidase__InfluenzaA__AHZ40653
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccggguaccggaacuggagcaagccccagugcggcaucaccggguucgcgcccuucuccaaggacaacagcauccgccuguccgccggcggggacaucugggucacccgggagcccuacgugagcugcgacccggacaagugcuaccaguucgcccugggccagggcaccacgcucaacaacgugcacuccaacaacaccguccgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggcuccgccagcgggaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaagggcagcaaccgccccaucguggacaucaacaucaaggaccacuccaucgucagcuccuacgugugcagcgggcuggugggcgacaccccgcggaagaacgacuccagcuccagcucccacugccuggaccccaacaacgaggagggcgggcacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86389 - RNA, 1410 nt, Artificial Sequence; identical to SEQ ID NO: 84383
  derived and/or modified sequence opt1 from neuraminidase__InfluenzaA__AHZ40665

SEQ ID NO: 86390 - RNA, 1410 nt, Artificial Sequence; identical to SEQ ID NO: 84383
  derived and/or modified sequence opt1 from neuraminidase__InfluenzaA__AHZ40677

SEQ ID NO: 86391 - RNA, 1410 nt, Artificial Sequence; identical to SEQ ID NO: 83154
  derived and/or modified sequence opt1 from neuraminidase__InfluenzaA__AHZ40689

SEQ ID NO: 86392 - RNA, 1410 nt, Artificial Sequence
  derived and/or modified sequence opt1 from neuraminidase__InfluenzaA__AHZ40713
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggacaaguccggcuacagcgggaucuucuccgucgagggcaagagcugcaucaaccggugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86393 - RNA, 1410 nt, Artificial Sequence
  derived and/or modified sequence opt1 from neuraminidase__InfluenzaA__AHZ40725
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcggcuacgugugcuccgggcuggugggcgacacgccccggaagaacgacagcuccagcuccagccacugccuggaccccaacaacgaggagggcgggcacggggucaagggcugggccuucgacgacggcaacgacguguggauggggcgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaaguccugcaucaaccggugcuucuacguggagcugauccgcgggcggaaggaggagaccgaggugcucuggaccagcaacagcaucgucguguucugcggcacguccgggaccuacggcaccgggagcuggcccgacggcgccgaccugaaccugaugcccaucuga

SEQ ID NO: 86394 - RNA, 1410 nt, Artificial Sequence; identical to SEQ ID NO: 84372
  derived and/or modified sequence opt1 from neuraminidase__InfluenzaA__AHZ40737

SEQ ID NO: 86395 - RNA, 1410 nt, Artificial Sequence
  derived and/or modified sequence opt1 from neuraminidase__InfluenzaA__AHZ40749
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggccccuggcccgacggggccgaccugaaccucaugcccaucuga

SEQ ID NO: 86396 - RNA, 1410 nt, Artificial Sequence
  derived and/or modified sequence opt1 from neuraminidase__InfluenzaA__AHZ40761
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcauggccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccucgugggcgacacgccccgcaagaccgacuccagcuccagcucccacugccuggaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcuccagaucaaccgccaggugaucguggaccggggcgaccgguccggguacagcggcaucuucuccgucgagggcaagagcugcaucaaccgcugcuucuacguggagcugauccgggggcgcaagaaggagaccgccgugcuguggacgagcaacuccaucgucguguucugcggcaccagcgggaccuacggcaccggguccuggccggacggcgccgaccucaaccugaugcccaucuga

SEQ ID NO: 86397 - RNA, 1410 nt, Artificial Sequence; identical to SEQ ID NO: 83154
  derived and/or modified sequence opt1 from neuraminidase__InfluenzaA__AHZ40773

SEQ ID NO: 86398 - RNA, 1410 nt, Artificial Sequence; identical to SEQ ID NO: 77736
  derived and/or modified sequence opt1 from neuraminidase__InfluenzaA__AHZ40785

SEQ ID NO: 86399 - RNA, 1410 nt, Artificial Sequence; identical to SEQ ID NO: 77736
  derived and/or modified sequence opt1 from neuraminidase__InfluenzaA__AHZ40796

SEQ ID NO: 86400 - RNA, 1410 nt, Artificial Sequence; identical to SEQ ID NO: 77736
  derived and/or modified sequence opt1 from neuraminidase__InfluenzaA__AHZ40807

SEQ ID NO: 86401 - RNA, 1410 nt, Artificial Sequence; identical to SEQ ID NO: 77736
  derived and/or modified sequence opt1 from neuraminidase__InfluenzaA__AHZ40818

SEQ ID NO: 86402 - RNA, 1410 nt, Artificial Sequence; identical to SEQ ID NO: 77736
  derived and/or modified sequence opt1 from neuraminidase__InfluenzaA__AHZ40829

SEQ ID NO: 86403 - RNA, 1410 nt, Artificial Sequence; identical to SEQ ID NO: 77736
  derived and/or modified sequence opt1 from neuraminidase__InfluenzaA__AHZ40840

SEQ ID NO: 86404 - RNA, 1410 nt, Artificial Sequence; identical to SEQ ID NO: 77736
  derived and/or modified sequence opt1 from neuraminidase__InfluenzaA__AHZ40851

SEQ ID NO: 86405 - RNA, 1410 nt, Artificial Sequence; identical to SEQ ID NO: 77736
  derived and/or modified sequence opt1 from neuraminidase__InfluenzaA__AHZ40862

SEQ ID NO: 86406 - RNA, 1410 nt, Artificial Sequence; identical to SEQ ID NO: 77736
  derived and/or modified sequence opt1 from neuraminidase__InfluenzaA__AHZ40873

SEQ ID NO: 86407 - RNA, 1410 nt, Artificial Sequence; identical to SEQ ID NO: 77736
  derived and/or modified sequence opt1 from neuraminidase__InfluenzaA__AHZ40884

SEQ ID NO: 86408 - RNA, 1410 nt, Artificial Sequence; identical to SEQ ID NO: 77736
  derived and/or modified sequence opt1 from neuraminidase__InfluenzaA__AHZ40895

SEQ ID NO: 86409 - RNA, 1410 nt, Artificial Sequence; identical to SEQ ID NO: 77736
  derived and/or modified sequence opt1 from neuraminidase__InfluenzaA__AHZ40906

SEQ ID NO: 86410 - RNA, 1410 nt, Artificial Sequence; identical to SEQ ID NO: 77736
  derived and/or modified sequence opt1 from neuraminidase__InfluenzaA__AHZ40917

SEQ ID NO: 86411 - RNA, 1410 nt, Artificial Sequence; identical to SEQ ID NO: 77736
  derived and/or modified sequence opt1 from neuraminidase__InfluenzaA__AHZ40928

SEQ ID NO: 86412 - RNA, 1410 nt, Artificial Sequence; identical to SEQ ID NO: 77736
  derived and/or modified sequence opt1 from neuraminidase__InfluenzaA__AHZ40939

SEQ ID NO: 86413 - RNA, 1410 nt, Artificial Sequence; identical to SEQ ID NO: 77736
  derived and/or modified sequence opt1 from neuraminidase__InfluenzaA__AHZ40950

SEQ ID NO: 86414 - RNA, 1410 nt, Artificial Sequence; identical to SEQ ID NO: 77736
  derived and/or modified sequence opt1 from neuraminidase__InfluenzaA__AHZ40961

SEQ ID NO: 86415 - RNA, 1410 nt, Artificial Sequence; identical to SEQ ID NO: 77736
  derived and/or modified sequence opt1 from neuraminidase__InfluenzaA__AHZ40972

SEQ ID NO: 86416 - RNA, 1410 nt, Artificial Sequence; identical to SEQ ID NO: 77736
  derived and/or modified sequence opt1 from neuraminidase__InfluenzaA__AHZ40983

SEQ ID NO: 86417 - RNA, 1410 nt, Artificial Sequence; identical to SEQ ID NO: 77736
  derived and/or modified sequence opt1 from neuraminidase__InfluenzaA__AHZ40994

SEQ ID NO: 86418 - RNA, 1410 nt, Artificial Sequence; identical to SEQ ID NO: 77736
  derived and/or modified sequence opt1 from neuraminidase__InfluenzaA__AHZ41005

SEQ ID NO: 86419 - RNA, 1410 nt, Artificial Sequence; identical to SEQ ID NO: 77736
  derived and/or modified sequence opt1 from neuraminidase__InfluenzaA__AHZ41016

SEQ ID NO: 86420 - RNA, 1410 nt, Artificial Sequence; identical to SEQ ID NO: 77736
  derived and/or modified sequence opt1 from neuraminidase__InfluenzaA__AHZ41027

SEQ ID NO: 86421 - RNA, 1410 nt, Artificial Sequence; identical to SEQ ID NO: 77736
  derived and/or modified sequence opt1 from neuraminidase__InfluenzaA__AHZ41049

SEQ ID NO: 86422 - RNA, 1410 nt, Artificial Sequence; identical to SEQ ID NO: 77736
  derived and/or modified sequence opt1 from neuraminidase__InfluenzaA__AHZ41060

SEQ ID NO: 86423 - RNA, 1410 nt, Artificial Sequence; identical to SEQ ID NO: 77736
  derived and/or modified sequence opt1 from neuraminidase__InfluenzaA__AHZ41071

SEQ ID NO: 86424 - RNA, 1410 nt, Artificial Sequence; identical to SEQ ID NO: 77736
  derived and/or modified sequence opt1 from neuraminidase__InfluenzaA__AHZ41082

SEQ ID NO: 86425 - RNA, 1410 nt, Artificial Sequence; identical to SEQ ID NO: 77736
  derived and/or modified sequence opt1 from neuraminidase__InfluenzaA__AHZ41093

SEQ ID NO: 86426 - RNA, 1410 nt, Artificial Sequence; identical to SEQ ID NO: 77736
  derived and/or modified sequence opt1 from neuraminidase__InfluenzaA__AHZ41104

SEQ ID NO: 86427 - RNA, 1410 nt, Artificial Sequence; identical to SEQ ID NO: 77736
  derived and/or modified sequence opt1 from neuraminidase__InfluenzaA__AHZ41115

SEQ ID NO: 86428 - RNA, 1410 nt, Artificial Sequence; identical to SEQ ID NO: 77736
  derived and/or modified sequence opt1 from neuraminidase__InfluenzaA__AHZ41126

SEQ ID NO: 86429 - RNA, 1410 nt, Artificial Sequence; identical to SEQ ID NO: 77736
  derived and/or modified sequence opt1 from neuraminidase__InfluenzaA__AHZ41137

SEQ ID NO: 86430 - RNA, 1410 nt, Artificial Sequence; identical to SEQ ID NO: 77736
  derived and/or modified sequence opt1 from neuraminidase__InfluenzaA__AHZ41148

SEQ ID NO: 86431 - RNA, 1410 nt, Artificial Sequence; identical to SEQ ID NO: 77736
  derived and/or modified sequence opt1 from neuraminidase__InfluenzaA__AHZ41159

SEQ ID NO: 86432 - RNA, 1410 nt, Artificial Sequence; identical to SEQ ID NO: 77736
  derived and/or modified sequence opt1 from neuraminidase__InfluenzaA__AHZ41170

SEQ ID NO: 86433 - RNA, 1410 nt, Artificial Sequence; identical to SEQ ID NO: 77736
  derived and/or modified sequence opt1 from neuraminidase__InfluenzaA__AHZ41181

SEQ ID NO: 86434 - RNA, 1410 nt, Artificial Sequence; identical to SEQ ID NO: 77736
  derived and/or modified sequence opt1 from neuraminidase__InfluenzaA__AHZ41205

SEQ ID NO: 86435 - RNA, 1410 nt, Artificial Sequence; identical to SEQ ID NO: 77736
  derived and/or modified sequence opt1 from neuraminidase__InfluenzaA__AHZ41251

SEQ ID NO: 86436 - RNA, 1410 nt, Artificial Sequence; identical to SEQ ID NO: 77736
  derived and/or modified sequence opt1 from neuraminidase__InfluenzaA__AHZ41266

SEQ ID NO: 86437 - RNA, 1410 nt, Artificial Sequence; identical to SEQ ID NO: 77736
  derived and/or modified sequence opt1 from neuraminidase__InfluenzaA__AHZ41284

SEQ ID NO: 86438 - RNA, 1410 nt, Artificial Sequence; identical to SEQ ID NO: 77736
  derived and/or modified sequence opt1 from neuraminidase__InfluenzaA__AHZ41295

SEQ ID NO: 86439 - RNA, 1410 nt, Artificial Sequence; identical to SEQ ID NO: 77736
  derived and/or modified sequence opt1 from neuraminidase__InfluenzaA__AHZ41306

SEQ ID NO: 86440 - RNA, 1410 nt, Artificial Sequence; identical to SEQ ID NO: 77736
  derived and/or modified sequence opt1 from neuraminidase__InfluenzaA__AHZ41317

SEQ ID NO: 86441 - RNA, 1410 nt, Artificial Sequence; identical to SEQ ID NO: 77736
  derived and/or modified sequence opt1 from neuraminidase__InfluenzaA__AHZ41328

SEQ ID NO: 86442 - RNA, 1410 nt, Artificial Sequence; identical to SEQ ID NO: 77736
  derived and/or modified sequence opt1 from neuraminidase__InfluenzaA__AHZ41339

SEQ ID NO: 86443 - RNA, 1410 nt, Artificial Sequence; identical to SEQ ID NO: 77736
  derived and/or modified sequence opt1 from neuraminidase__InfluenzaA__AHZ41350

SEQ ID NO: 86444 - RNA, 1410 nt, Artificial Sequence; identical to SEQ ID NO: 77736
  derived and/or modified sequence opt1 from neuraminidase__InfluenzaA__AHZ41369

SEQ ID NO: 86445 - RNA, 1410 nt, Artificial Sequence; identical to SEQ ID NO: 77736
  derived and/or modified sequence opt1 from neuraminidase__InfluenzaA__AHZ41380

SEQ ID NO: 86446 - RNA, 1410 nt, Artificial Sequence; identical to SEQ ID NO: 77736
  derived and/or modified sequence opt1 from neuraminidase__InfluenzaA__AHZ41391

SEQ ID NO: 86447 - RNA, 1410 nt, Artificial Sequence; identical to SEQ ID NO: 77736
  derived and/or modified sequence opt1 from neuraminidase__InfluenzaA__AHZ41402

SEQ ID NO: 86448 - RNA, 1410 nt, Artificial Sequence; identical to SEQ ID NO: 77736
  derived and/or modified sequence opt1 from neuraminidase__InfluenzaA__AHZ41413

SEQ ID NO: 86449 - RNA, 1410 nt, Artificial Sequence; identical to SEQ ID NO: 77736
  derived and/or modified sequence opt1 from neuraminidase__InfluenzaA__AHZ41444

SEQ ID NO: 86450 - RNA, 1410 nt, Artificial Sequence; identical to SEQ ID NO: 77736
  derived and/or modified sequence opt1 from neuraminidase__InfluenzaA__AHZ41455

SEQ ID NO: 86451 - RNA, 1410 nt, Artificial Sequence; identical to SEQ ID NO: 77736
  derived and/or modified sequence opt1 from neuraminidase__InfluenzaA__AHZ41476

SEQ ID NO: 86452 - RNA, 1410 nt, Artificial Sequence; identical to SEQ ID NO: 77736
  derived and/or modified sequence opt1 from neuraminidase__InfluenzaA__AHZ41487

SEQ ID NO: 86453 - RNA, 1410 nt, Artificial Sequence; identical to SEQ ID NO: 77736
  derived and/or modified sequence opt1 from neuraminidase__InfluenzaA__AHZ41498

SEQ ID NO: 86454 - RNA, 1410 nt, Artificial Sequence; identical to SEQ ID NO: 77736
  derived and/or modified sequence opt1 from neuraminidase__InfluenzaA__AHZ41509

SEQ ID NO: 86455 - RNA, 1410 nt, Artificial Sequence; identical to SEQ ID NO: 77736
  derived and/or modified sequence opt1 from neuraminidase__InfluenzaA__AHZ41520

SEQ ID NO: 86456 - RNA, 1410 nt, Artificial Sequence; identical to SEQ ID NO: 77736
  derived and/or modified sequence opt1 from neuraminidase__InfluenzaA__AHZ41531

SEQ ID NO: 86457 - RNA, 1410 nt, Artificial Sequence; identical to SEQ ID NO: 77736
  derived and/or modified sequence opt1 from neuraminidase__InfluenzaA__AHZ41542

SEQ ID NO: 86458 - RNA, 1410 nt, Artificial Sequence; identical to SEQ ID NO: 77736
  derived and/or modified sequence opt1 from neuraminidase__InfluenzaA__AHZ41553

SEQ ID NO: 86459 - RNA, 1410 nt, Artificial Sequence; identical to SEQ ID NO: 77736
  derived and/or modified sequence opt1 from neuraminidase__InfluenzaA__AHZ41564

SEQ ID NO: 86460 - RNA, 1410 nt, Artificial Sequence; identical to SEQ ID NO: 77736
  derived and/or modified sequence opt1 from neuraminidase__InfluenzaA__AHZ41586

SEQ ID NO: 86461 - RNA, 1410 nt, Artificial Sequence; identical to SEQ ID NO: 77736
  derived and/or modified sequence opt1 from neuraminidase__InfluenzaA__AHZ41597

SEQ ID NO: 86462 - RNA, 1410 nt, Artificial Sequence; identical to SEQ ID NO: 77736
  derived and/or modified sequence opt1 from neuraminidase__InfluenzaA__AHZ41608

SEQ ID NO: 86463 - RNA, 1410 nt, Artificial Sequence; identical to SEQ ID NO: 77736
  derived and/or modified sequence opt1 from neuraminidase__InfluenzaA__AHZ41619

SEQ ID NO: 86464 - RNA, 1410 nt, Artificial Sequence; identical to SEQ ID NO: 77736
  derived and/or modified sequence opt1 from neuraminidase__InfluenzaA__AHZ41630

SEQ ID NO: 86465 - RNA, 1410 nt, Artificial Sequence; identical to SEQ ID NO: 77736
  derived and/or modified sequence opt1 from neuraminidase__InfluenzaA__AHZ41641

SEQ ID NO: 86466 - RNA, 1410 nt, Artificial Sequence; identical to SEQ ID NO: 77736
  derived and/or modified sequence opt1 from neuraminidase__InfluenzaA__AHZ41652

SEQ ID NO: 86467 - RNA, 1410 nt, Artificial Sequence; identical to SEQ ID NO: 77736
  derived and/or modified sequence opt1 from neuraminidase__InfluenzaA__AHZ41663

SEQ ID NO: 86468 - RNA, 1410 nt, Artificial Sequence; identical to SEQ ID NO: 77736
  derived and/or modified sequence opt1 from neuraminidase__InfluenzaA__AHZ41674

SEQ ID NO: 86469 - RNA, 1410 nt, Artificial Sequence; identical to SEQ ID NO: 77736
  derived and/or modified sequence opt1 from neuraminidase__InfluenzaA__AHZ41685

SEQ ID NO: 86470 - RNA, 1410 nt, Artificial Sequence; identical to SEQ ID NO: 77736
  derived and/or modified sequence opt1 from neuraminidase__InfluenzaA__AHZ41696

SEQ ID NO: 86471 - RNA, 1410 nt, Artificial Sequence; identical to SEQ ID NO: 77736
  derived and/or modified sequence opt1 from neuraminidase__InfluenzaA__AHZ41707

SEQ ID NO: 86472 - RNA, 1410 nt, Artificial Sequence; identical to SEQ ID NO: 77736
  derived and/or modified sequence opt1 from neuraminidase__InfluenzaA__AHZ41718

SEQ ID NO: 86473 - RNA, 1410 nt, Artificial Sequence; identical to SEQ ID NO: 77736
  derived and/or modified sequence opt1 from neuraminidase__InfluenzaA__AHZ41729

SEQ ID NO: 86474 - RNA, 1410 nt, Artificial Sequence; identical to SEQ ID NO: 77736
  derived and/or modified sequence opt1 from neuraminidase__InfluenzaA__AHZ41740

SEQ ID NO: 86475 - RNA, 1410 nt, Artificial Sequence; identical to SEQ ID NO: 77736
  derived and/or modified sequence opt1 from neuraminidase__InfluenzaA__AHZ41751

SEQ ID NO: 86476 - RNA, 1410 nt, Artificial Sequence; identical to SEQ ID NO: 77736
  derived and/or modified sequence opt1 from neuraminidase__InfluenzaA__AHZ41762

SEQ ID NO: 86477 - RNA, 1410 nt, Artificial Sequence; identical to SEQ ID NO: 84397
  derived and/or modified sequence opt1 from neuraminidase__InfluenzaA__AHZ42564

SEQ ID NO: 86478 - RNA, 1410 nt, Artificial Sequence; identical to SEQ ID NO: 83154
  derived and/or modified sequence opt1 from neuraminidase__InfluenzaA__AHZ42575

SEQ ID NO: 86479 - RNA, 1410 nt, Artificial Sequence
  derived and/or modified sequence opt1 from neuraminidase__InfluenzaA__AHZ42587
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86480 - RNA, 1413 nt, Artificial Sequence
  derived and/or modified sequence opt1 from neuraminidase__InfluenzaA__AHZ42599
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaagaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcgagaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86481 - RNA, 1410 nt, Artificial Sequence; identical to SEQ ID NO: 85800
  derived and/or modified sequence opt1 from neuraminidase__InfluenzaA__AHZ42611

SEQ ID NO: 86482 - RNA, 1410 nt, Artificial Sequence; identical to SEQ ID NO: 83154
  derived and/or modified sequence opt1 from neuraminidase__InfluenzaA__AHZ42622

SEQ ID NO: 86483 - RNA, 1410 nt, Artificial Sequence; identical to SEQ ID NO: 86341
  derived and/or modified sequence opt1 from neuraminidase__InfluenzaA__AHZ42634

SEQ ID NO: 86484 - RNA, 1410 nt, Artificial Sequence; identical to SEQ ID NO: 86384
  derived and/or modified sequence opt1 from neuraminidase__InfluenzaA__AHZ42646

SEQ ID NO: 86485 - RNA, 1410 nt, Artificial Sequence; identical to SEQ ID NO: 83154
  derived and/or modified sequence opt1 from neuraminidase__InfluenzaA__AHZ42657

SEQ ID NO: 86486 - RNA, 1410 nt, Artificial Sequence; identical to SEQ ID NO: 86101
  derived and/or modified sequence opt1 from neuraminidase__InfluenzaA__AHZ42669

SEQ ID NO: 86487 - RNA, 1410 nt, Artificial Sequence; identical to SEQ ID NO: 83154
  derived and/or modified sequence opt1 from neuraminidase__InfluenzaA__AHZ42681

SEQ ID NO: 86488 - RNA, 1410 nt, Artificial Sequence
  derived and/or modified sequence opt1 from neuraminidase__InfluenzaA__AHZ42693
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggcauggacugcauccgccccugcuucugggucgagcugauccggggccgccccaaggagaacaccaucuggaccagcggguccaucaucagcuucugcggcgugaacuccgacaccgucggguggagcuggcccgacggcgccgagcucccguucacgaucgacaaguga

SEQ ID NO: 86489 - RNA, 1410 nt, Artificial Sequence; identical to SEQ ID NO: 83154
  derived and/or modified sequence opt1 from neuraminidase__InfluenzaA__AHZ42704

SEQ ID NO: 86490 - RNA, 1410 nt, Artificial Sequence
  derived and/or modified sequence opt1 from neuraminidase__InfluenzaA__AHZ42716
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaaguuccagaucaaccgccaggugaucguggaccgcggggaccgguccggcuacagcgggaucuucuccgucgagggcaagagcugcaucaaccggugcuucuacguggagcugauccgcggccggaaggaggagaccgaggugcuguggaccagcaacuccaucgucguguucugcgggacgagcggcaccuacgggaccggcuccuggcccgacggggccgaccucaaccugaugcccaucuga

SEQ ID NO: 86491 - RNA, 1410 nt, Artificial Sequence; identical to SEQ ID NO: 83154
  derived and/or modified sequence opt1 from neuraminidase__InfluenzaA__AHZ42728

SEQ ID NO: 86492 - RNA, 1410 nt, Artificial Sequence; identical to SEQ ID NO: 84397
  derived and/or modified sequence opt1 from neuraminidase__InfluenzaA__AHZ42740

SEQ ID NO: 86493 - RNA, 1410 nt, Artificial Sequence; identical to SEQ ID NO: 84365
  derived and/or modified sequence opt1 from neuraminidase__InfluenzaA__AHZ42751

SEQ ID NO: 86494 - RNA, 1410 nt, Artificial Sequence
  derived and/or modified sequence opt1 from neuraminidase__InfluenzaA__AHZ42763
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucguguacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccgccaggugaucguggaccggggcgaccggagcggguacuccggcaucuucagcgucgaggggaaguccugcaucaaccgcugcuucuacguggagcugauccggggccgcaaggaggagaccgaggugcucuggaccagcaacagcaucgucguguucugcggcacguccgggaccuacggcaccgggagcuggcccgacggcgccgaccugaaccugaugcccaucuga

SEQ ID NO: 86495 - RNA, 1410 nt, Artificial Sequence; identical to SEQ ID NO: 84383
  derived and/or modified sequence opt1 from neuraminidase__InfluenzaA__AHZ42775

SEQ ID NO: 86496 - RNA, 1410 nt, Artificial Sequence; identical to SEQ ID NO: 83154
  derived and/or modified sequence opt1 from neuraminidase__InfluenzaA__AHZ42787

SEQ ID NO: 86497 - RNA, 1410 nt, Artificial Sequence
  derived and/or modified sequence opt1 from neuraminidase__InfluenzaA__AHZ42799
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucaucgacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86498 - RNA, 1410 nt, Artificial Sequence
  derived and/or modified sequence opt1 from neuraminidase__InfluenzaA__AHZ42811
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggggcggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86499 - RNA, 1410 nt, Artificial Sequence
  derived and/or modified sequence opt1 from neuraminidase__InfluenzaA__AHZ42823
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcggagcaguccgucgugagcgugaagcuggccggcaacuccagccucugcccggucuccgggugggccaucuacagcaaggacaacuccgugcgcaucggcagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccguggccuggagcgcguccgccugccacgacggcaucaacuggcucaccaucgggaucagcggccccgacuccggcgccgucgccgugcugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucagcuucaaguacgggaacggcgucuggaucgggcgcaccaaguccaucagcucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 86500 - RNA, 1410 nt, Artificial Sequence
  derived and/or modified sequence opt1 from neuraminidase__InfluenzaA__AHZ42834
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86501 - RNA, 1410 nt, Artificial Sequence; identical to SEQ ID NO: 83154
  derived and/or modified sequence opt1 from neuraminidase__InfluenzaA__AHZ42846

SEQ ID NO: 86502 - RNA, 1410 nt, Artificial Sequence; identical to SEQ ID NO: 83154
  derived and/or modified sequence opt1 from neuraminidase__InfluenzaA__AHZ42858

SEQ ID NO: 86503 - RNA, 1410 nt, Artificial Sequence; identical to SEQ ID NO: 83154
  derived and/or modified sequence opt1 from neuraminidase__InfluenzaA__AHZ42870

SEQ ID NO: 86504 - RNA, 1410 nt, Artificial Sequence; identical to SEQ ID NO: 83154
  derived and/or modified sequence opt1 from neuraminidase__InfluenzaA__AHZ42882

SEQ ID NO: 86505 - RNA, 1410 nt, Artificial Sequence
  derived and/or modified sequence opt1 from neuraminidase__InfluenzaA__AHZ42894
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggacaagggggaccgguccggcuacagcgggaucuucuccgucgagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86506 - RNA, 1410 nt, Artificial Sequence; identical to SEQ ID NO: 83154
  derived and/or modified sequence opt1 from neuraminidase__InfluenzaA__AHZ42906

SEQ ID NO: 86507 - RNA, 1410 nt, Artificial Sequence; identical to SEQ ID NO: 84383
  derived and/or modified sequence opt1 from neuraminidase__InfluenzaA__AHZ42918

SEQ ID NO: 86508 - RNA, 1398 nt, Artificial Sequence; identical to SEQ ID NO: 84462
  derived and/or modified sequence opt1 from neuraminidase__InfluenzaA__AHZ59750

SEQ ID NO: 86509 - RNA, 1398 nt, Artificial Sequence; identical to SEQ ID NO: 84462
  derived and/or modified sequence opt1 from neuraminidase__InfluenzaA__AHZ59762

SEQ ID NO: 86510 - RNA, 1398 nt, Artificial Sequence; identical to SEQ ID NO: 84462
  derived and/or modified sequence opt1 from neuraminidase__InfluenzaA__AHZ59774

SEQ ID NO: 86511 - RNA, 1398 nt, Artificial Sequence; identical to SEQ ID NO: 84462
  derived and/or modified sequence opt1 from neuraminidase__InfluenzaA__AHZ59786

SEQ ID NO: 86512 - RNA, 1398 nt, Artificial Sequence; identical to SEQ ID NO: 84462
  derived and/or modified sequence opt1 from neuraminidase__InfluenzaA__AHZ59798

SEQ ID NO: 86513 - RNA, 1398 nt, Artificial Sequence; identical to SEQ ID NO: 84462
  derived and/or modified sequence opt1 from neuraminidase__InfluenzaA__AHZ59810

SEQ ID NO: 86514 - RNA, 1398 nt, Artificial Sequence; identical to SEQ ID NO: 84462
  derived and/or modified sequence opt1 from neuraminidase__InfluenzaA__AHZ59822

SEQ ID NO: 86515 - RNA, 1398 nt, Artificial Sequence; identical to SEQ ID NO: 84462
  derived and/or modified sequence opt1 from neuraminidase__InfluenzaA__AHZ59834

SEQ ID NO: 86516 - RNA, 1398 nt, Artificial Sequence; identical to SEQ ID NO: 84462
  derived and/or modified sequence opt1 from neuraminidase__InfluenzaA__AHZ59846

SEQ ID NO: 86517 - RNA, 1398 nt, Artificial Sequence; identical to SEQ ID NO: 84462
  derived and/or modified sequence opt1 from neuraminidase__InfluenzaA__AHZ59858

SEQ ID NO: 86518 - RNA, 1398 nt, Artificial Sequence; identical to SEQ ID NO: 84462
  derived and/or modified sequence opt1 from neuraminidase__InfluenzaA__AHZ59870

SEQ ID NO: 86519 - RNA, 1398 nt, Artificial Sequence; identical to SEQ ID NO: 84462
  derived and/or modified sequence opt1 from neuraminidase__InfluenzaA__AHZ59882

SEQ ID NO: 86520 - RNA, 1398 nt, Artificial Sequence; identical to SEQ ID NO: 84462
  derived and/or modified sequence opt1 from neuraminidase__InfluenzaA__AHZ59918

SEQ ID NO: 86521 - RNA, 1398 nt, Artificial Sequence; identical to SEQ ID NO: 84462
  derived and/or modified sequence opt1 from neuraminidase__InfluenzaA__AHZ59930

SEQ ID NO: 86522 - RNA, 1398 nt, Artificial Sequence; identical to SEQ ID NO: 84462
  derived and/or modified sequence opt1 from neuraminidase__InfluenzaA__AHZ59942

SEQ ID NO: 86523 - RNA, 1398 nt, Artificial Sequence; identical to SEQ ID NO: 84462
  derived and/or modified sequence opt1 from neuraminidase__InfluenzaA__AHZ59954

SEQ ID NO: 86524 - RNA, 1398 nt, Artificial Sequence; identical to SEQ ID NO: 84462
  derived and/or modified sequence opt1 from neuraminidase__InfluenzaA__AHZ59966

SEQ ID NO: 86525 - RNA, 1398 nt, Artificial Sequence; identical to SEQ ID NO: 84462
  derived and/or modified sequence opt1 from neuraminidase__InfluenzaA__AHZ59991

SEQ ID NO: 86526 - RNA, 1398 nt, Artificial Sequence; identical to SEQ ID NO: 84462
  derived and/or modified sequence opt1 from neuraminidase__InfluenzaA__AHZ60003

SEQ ID NO: 86527 - RNA, 1398 nt, Artificial Sequence; identical to SEQ ID NO: 84462
  derived and/or modified sequence opt1 from neuraminidase__InfluenzaA__AHZ60015

SEQ ID NO: 86528 - RNA, 1398 nt, Artificial Sequence; identical to SEQ ID NO: 84462
  derived and/or modified sequence opt1 from neuraminidase__InfluenzaA__AHZ60027

SEQ ID NO: 86529 - RNA, 1398 nt, Artificial Sequence; identical to SEQ ID NO: 84462
  derived and/or modified sequence opt1 from neuraminidase__InfluenzaA__AHZ60039

SEQ ID NO: 86530 - RNA, 1398 nt, Artificial Sequence; identical to SEQ ID NO: 84462
  derived and/or modified sequence opt1 from neuraminidase__InfluenzaA__AHZ60051

SEQ ID NO: 86531 - RNA, 1398 nt, Artificial Sequence; identical to SEQ ID NO: 84462
  derived and/or modified sequence opt1 from neuraminidase__InfluenzaA__AHZ60063

SEQ ID NO: 86532 - RNA, 1398 nt, Artificial Sequence; identical to SEQ ID NO: 84462
  derived and/or modified sequence opt1 from neuraminidase__InfluenzaA__AHZ60075

SEQ ID NO: 86533 - RNA, 1398 nt, Artificial Sequence; identical to SEQ ID NO: 84462
  derived and/or modified sequence opt1 from neuraminidase__InfluenzaA__AHZ60087

SEQ ID NO: 86534 - RNA, 1398 nt, Artificial Sequence; identical to SEQ ID NO: 84462
  derived and/or modified sequence opt1 from neuraminidase__InfluenzaA__AHZ60099

SEQ ID NO: 86535 - RNA, 1410 nt, Artificial Sequence; identical to SEQ ID NO: 83154
  derived and/or modified sequence opt1 from neuraminidase__InfluenzaA__AHZ60111

SEQ ID NO: 86536 - RNA, 1410 nt, Artificial Sequence; identical to SEQ ID NO: 77410
  derived and/or modified sequence opt1 from neuraminidase__InfluenzaA__AIA26299

SEQ ID NO: 86537 - RNA, 1374 nt, Artificial Sequence
  derived and/or modified sequence opt1 from neuraminidase__InfluenzaA__AIC64891
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacgcagggcgcccuccugaacgacaagcacuccaacgggaccaucaaggaccggagccccuaccgcacccugauguccugcccgaucggcgaggugcccagccccuacaacucccgguucgagagcgucgccuggagcgcguccgccugccacgacgggaucaacuggcucaccaucggcaucagcggccccgacaacggggccguggccgugcugaaguacaacggcaucaucacggacaccaucaaguccuggcgcaacaacauccugcggacccaggagagcgagugcgcgugcgucaacggguccugcuucaccgugaugacggacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggacguccgggagcuccaucagcuucugcggcgucaacuccgacaccgugggguggagcuggcccgacggcgccgagcugccguucaccaucgacaaguga

SEQ ID NO: 86538 - RNA, 1350 nt, Artificial Sequence
  derived and/or modified sequence opt1 from neuraminidase__InfluenzaA__AID48084
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaaccugcucaccgagaagaccguggccagcgucaagcuggcgggcaacuccagccugugccccaucaacgggugggccguguacuccaaggacaacagcauccgcaucggcuccaagggcgacguguucgucauccgggagcccuucaucagcugcucccaccucgagugccgcacguucuuccugacccagggggcccugcucaacgacaagcacagcaacggcaccgugaaggaccggagcccccaccgcacccugauguccugcccggugggggaggcccccucccccuacaacagccgguucgaguccgucgccuggagcgcgagcgccugccacgacggcacguccuggcugaccaucgggaucagcggccccgacaacggcgccguggccgugcucaaguacaacgggaucaucaccgacaccaucaaguccuggcgcaacaacauccugcggacgcaggagagcgagugcgcgugcgucaacggcuccugcuucaccgugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccucgaguaccagaucggguacaucugcagcggcguguucggggacaacccgcgccccaacgacggcgccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcugaccgggcuggacugcauccggcccugcuucugggucgagcucauccgcggccggcccaaggaguccaccaucuggaccagcggcuccagcaucuccuucugcggggugaacagcgacacggugggcugguccuggcccgacggggccgagcugccguucaccaucgacaaguga

SEQ ID NO: 86539 - RNA, 1410 nt, Artificial Sequence
  derived and/or modified sequence opt1 from neuraminidase__InfluenzaA__AID70507
augaaccccaaccagaagaucaucaccaucggcagcgugugcaccacgaucgggauggccaaccugauccuccagaucggcaacaucaucuccaucuggaucagccacuccauccagcuggggaaccagaaccagaucgagaccugcaaccagagcgucaucaccuacgagaacaagaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcgaccccguguccuucaacggcgccaacggggugaagggcuucagcuucaaguacgggaacggcgucuggaucgggcgcaccaaguccaucagcagccggaacggcuucgagaugaucugggaccccaacggcuggaccgggacggacaacaaguucuccaucaagcaggacaucgugggcaucaacgaguggagcggguacuccggcagcuucgugcagcacccggagcugaccgggcuggacugcauccgccccugcuucugggucgagcucauccggggccgccccaaggagaacaccaucuggaccuccggcagcuccaucagcuucugcggggugaacuccgacacggucggcugguucuggcccgacggggccgagcugccguucaccaucgacaaguga

SEQ ID NO: 86540 - RNA, 1410 nt, Artificial Sequence
  derived and/or modified sequence opt1 from neuraminidase__InfluenzaA__AID70508
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccaacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86541 - RNA, 1410 nt, Artificial Sequence
  derived and/or modified sequence opt1 from neuraminidase__InfluenzaA__AID70509
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucaacucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86542 - RNA, 1410 nt, Artificial Sequence
  derived and/or modified sequence opt1 from neuraminidase__InfluenzaA__AID70510
augaaccccaaccagaagaucaucaccaucggcagcgugugcaucaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86543 - RNA, 1410 nt, Artificial Sequence
  derived and/or modified sequence opt1 from neuraminidase__InfluenzaA__AID70511
augaaccccaaccagaagaucaucaccaugggcagcguguggaugaccaucgggauggccaaccugauccuccaguccggcaacaucaucagcaucuggaucucccacagcauccagcugcgcaaccagucccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggagguccccagccccuacaacucccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgagaagggcaagaucgugaaguccgucgagaugaacgcccccaacuaccacuacgaggagugcagcugcuaccccgacuccagcgagaucacgugcgugugccgcgacaacuggcacggguccaaccggcccugggugagcuucaaccagaaccucgaguaccagaucggcuacaucugcuccgggaucuucggcgacaacccgcgccccaacgacaagaccgggagcugcggccccgucuccagcaacggcgccaacggggugaagggcuucagcuucaaguacgggaacggcguguggaucgggcggaccaaguccaucagcucccgcaagggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 86544 - RNA, 1410 nt, Artificial Sequence
  derived and/or modified sequence opt1 from neuraminidase__InfluenzaA__AID70512
augaaccccaaccagaagaucaucaccaucggcagcguguggaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaaggcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucaucgggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86545 - RNA, 1410 nt, Artificial Sequence; identical to SEQ ID NO: 81265
  derived and/or modified sequence opt1 from neuraminidase__InfluenzaA__AID70514

SEQ ID NO: 86546 - RNA, 1410 nt, Artificial Sequence
  derived and/or modified sequence opt1 from neuraminidase__InfluenzaA__AID70515
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacagcaacgggguguggaucggccggaccaaguccaucagcucccgcaagggguucgagaugaucugggaccccaacggcuggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcgggcggcccaaggagaacaccaucuggaccagcggcuccagcaucuccuucugcggcgucaacagcgacaccguggggugguccuggcccgacggcgccgagcugccguucacgaucgacaaguga

SEQ ID NO: 86547 - RNA, 1410 nt, Artificial Sequence; identical to SEQ ID NO: 84166
  derived and/or modified sequence opt1 from neuraminidase__InfluenzaA__AID70516

SEQ ID NO: 86548 - RNA, 1410 nt, Artificial Sequence
  derived and/or modified sequence opt1 from neuraminidase__InfluenzaA__AID70517
augaaccccaaccagaagaucaucaccaucggcagcgugugcaugaccaucgggauggccaaccugacgcuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccaucaugaccgacggcccgaacgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaagggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 86549 - RNA, 1410 nt, Artificial Sequence
  derived and/or modified sequence opt1 from neuraminidase__InfluenzaA__AID70518
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagauccccagccccuacaacagccgcuucgaguccgucgccuggagcgcguccgccugccacgacggcaucaacuggcucaccaucgggaucagcggccccgacaacggcgccguggccgugcugaaguacaacgggaucaucaccgacaccaucaaguccuggcggaacaacauccugcgcacgcaggagagcgagugcgcgugcgucaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgugagcuccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggagcggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 86550 - RNA, 1410 nt, Artificial Sequence
  derived and/or modified sequence opt1 from neuraminidase__InfluenzaA__AID70519
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaaggcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86551 - RNA, 1410 nt, Artificial Sequence
  derived and/or modified sequence opt1 from neuraminidase__InfluenzaA__AID70520
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccggcaccgugggguggagcuggcccgacggcgccgagcugccguucacgaucgacaaguga

SEQ ID NO: 86552 - RNA, 1410 nt, Artificial Sequence
  derived and/or modified sequence opt1 from neuraminidase__InfluenzaA__AID70521
augaaccccaaccagaagaucaucaccaucggcagcgugucccugaccaucagccgcaucugcuucuucaugcagaucgccauccucaucaacacggucacccugcacuucaagcaguacgaguucaacuccccgcccaacaaccaggugaugcugugcgagcccaccaucaucgagcggaacaucaccaagaucguguaccucacgaacaccaccaucgagaaggagaucugccccaagcuggccgaguaccgcagcugguccaagccgcagugcgacaucaccggguucgcgcccuucagcaaggacaacuccauccggcugagcgccggcggggacaucugggucacgcgcgagcccuacguguccugcgaccccgacaagugcuuccaguucgcccucggccaggggaccacccugaacaacgugcacagcaacgacaccguccacgaccggacgccguaccgcacccugcucaugaacgagcugggcgugcccuuccaccugggcaccaagcaggucugcaucgccugguccagcuccagcugccacgacgggaaggccuggcuccacgugugcaucaccggcgacgacaagaacgcgacggccuccaucaucuacaacgggcggcugguggacagcaucguguccuggagcaagaagauccugcgcacccaggaguccgagugcgucugcaucaacgggaccugcaccguggugaugacggacgggagcgccagcggcaaggccgacaccaagauccucuucaucgaggagggcaagaucguccacaccuccacccugagcggguccgcgcagcacguggaggagugcagcugcuacccccgguaccccggcgugcgcugcgucugccgggacaacuggaagggguccaaccgcccgaucguggacaucaacaucaaggacuacagcaucguguccagcuacgucugcuccggcuucgugggcgacacgccccggaagcccgaccgcagcuccagcucccacugccuggaccccaacaacgaggagggcggccacggggugaagggcugggccuucgacgacgggaacgacgucuggaugggccggaccaucagcgagaagucccgccucggcuacgagaccuucaaggugaucgggggcuggagcaacccgaacuccaagagccagaucaaccggcaggucaucguggaccgcgggaaccgguccggcuacagcgggaucuucagcguggagggcaaguccugcaucaaccgcugcuucuacgucgagcugauccggggccgcaaggacgagaccgaggugcuguggacgagcaacuccaucguggucuucugcgggaccagcggcaccuacgggaccggcuccuggcccgacggggccgacaucaaccucaugcccaucuga

SEQ ID NO: 86553 - RNA, 1410 nt, Artificial Sequence
  derived and/or modified sequence opt1 from neuraminidase__InfluenzaA__AID70522
augaaccccaaccagaagaucaucaccaucggcagcgugucccugaccaucagcacgaucugcuucuucaugcagaucgccauccucaucaccaccgucacccugcacuuccgccaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 86554 - RNA, 1410 nt, Artificial Sequence
  derived and/or modified sequence opt1 from neuraminidase__InfluenzaA__AID70523
augaaccccaaccagaagaucaagaccaucggcagcgugucccugaccaacagcacgaucugcaucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaguucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaaccucaugcccaucuga

SEQ ID NO: 86555 - RNA, 1410 nt, Artificial Sequence
  derived and/or modified sequence opt1 from neuraminidase__InfluenzaA__AID70524
augaaccccaaccagaagaucaucaccaucggcgccguguggcgcaccaucagcacgaucugcuucuucaugcagaucgccuuccugaucaccaccgucacccuccacuucaagcaguacgaguucaacuccccgcccaacaaccaggugaugcccugcgagcccacgaucaucgagcggaacaucaccgagaucguguaccugaccaacaccacgaucgagaaggagaucugcccgaagcuggcggaguaccgcaacuggagcaagccccagugcgacaucaccggguucgcccccuucuccaaggacaacagcauccggcucuccgccggcggggacaucugggucacccgcgagcccuacgugagcugcgacccggacaagugcuaccaguucgcccugggccaggggaccacgcugaacaacgugcacuccaacaacaccguccgggaccgcacccccuaccggacccuccugaugaacgagcugggcgugcccuuccaccucggcacgaagcaggucugcaucgccuggagcuccagcuccugccacgacgggaaggcguggcugcacgugugcaucaccggcgacgacaagaacgccaccgccagcuucaucuacaacgggcgccugguggacuccguggucagcugguccaaggagauccuccggacccaggagagcgagugcgugugcaucaacggcacgugcaccguggucaugaccgacggguccgccagcggcaaggcggacaccaagauccuguucaucgaggagggcaagaucgugcacacguccacccugagcgggagcgcccagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccugggcuacgagaccuucaaggucaucgaggggugguccaaccccaagagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccuccaacagcaucgucguguucugcggcacgagcgggaccuacggcaccggguccuggcccgacggcgccgaccucaaccugaugcccaucuga

SEQ ID NO: 86556 - RNA, 1410 nt, Artificial Sequence
  derived and/or modified sequence opt1 from neuraminidase__InfluenzaA__AID70525
augaaccccaaccagaagaucaucaccaucggcagcgugucccugaccaucuggaucaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacagcaacaacacgguccgcgaccggaccccguaccgcacccugcucaugaacgagcugggcgugcccuuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcguggucuccuggagcaaggagauccugcgcacccaggaguccgagugcgugugcaucaacgggaccugcacgguggucaugaccgacgggagcgccuccggcaaggccgacaccaagauccucuucaucgaggagggcaagaucgugcacaccagcacgcugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcaccuccgggacguacggcaccgggagcuggccggacggcgccgaccugaacaucaugcccaucuga

SEQ ID NO: 86557 - RNA, 1410 nt, Artificial Sequence; identical to SEQ ID NO: 80526
  derived and/or modified sequence opt1 from neuraminidase__InfluenzaA__AID70526

SEQ ID NO: 86558 - RNA, 1410 nt, Artificial Sequence
  derived and/or modified sequence opt1 from neuraminidase__InfluenzaA__AID70527
augaaccccaaccagaagaucaucaccaucggcagcgugucccugaccauguggaucaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacagcaacaacacgguccgcgaccggaccccguaccgcacccugcucaugaacgagcugggcgugcccuuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcguggucuccuggagcaaggagauccugcgcacccaggaguccgagugcgugugcaucaacgggaccugcacgguggucaugaccgacgggagcgccuccggcaaggccgacaccaagauccucuucaucgaggagggcaagaucgugcacaccagcacgcugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcaccuccgggacguacggcaccgggagcuggccggacggcgccgaccugaaccucaugcccaucuga

SEQ ID NO: 86559 - RNA, 1410 nt, Artificial Sequence
  derived and/or modified sequence opt1 from neuraminidase__InfluenzaA__AID70528
augaaccccaaccagaagaucaucaccaucggcagcgugucccugagcaucuccaccaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacagcaacaacacgguccgcgaccggaccccguaccgcacccugcucaugaacgagcugggcgugcccuuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcguggucuccuggagcaaggagauccugcgcacccaggaguccgagugcgugugcaucaacgggaccugcacgguggucaugaccgacgggagcgccagcggcaaggccgacaccaagauccucuucaucgaggagggcaagaucgugcacaccuccacgcugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 86560 - RNA, 1410 nt, Artificial Sequence; identical to SEQ ID NO: 80526
  derived and/or modified sequence opt1 from neuraminidase__InfluenzaA__AID70529

SEQ ID NO: 86561 - RNA, 1410 nt, Artificial Sequence
  derived and/or modified sequence opt1 from neuraminidase__InfluenzaA__AID70530
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaacaucaugcccaucuga

SEQ ID NO: 86562 - RNA, 1410 nt, Artificial Sequence; identical to SEQ ID NO: 80526
  derived and/or modified sequence opt1 from neuraminidase__InfluenzaA__AID70531

SEQ ID NO: 86563 - RNA, 1410 nt, Artificial Sequence
  derived and/or modified sequence opt1 from neuraminidase__InfluenzaA__AID70532
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagacccugaaggucaucgaggggugguccaaccccaagagcaagcuccagaucaaccgccaggugaucguggaccggggcaaccgcuccggguacuacggcaucuucagcgucgaggggaaguccugcaucaaccggugcuucuacguggagcugaucuggggccgcaaggaggagaucgaggugcuguggaccagcaacagcaaggucguguucugcggcaccuccgggacguacggcaccgggagcuccccggacggcgccgaccucaacuucaugcccaucuga

SEQ ID NO: 86564 - RNA, 1410 nt, Artificial Sequence
  derived and/or modified sequence opt1 from neuraminidase__InfluenzaA__AID70533
augaaccccaaccagaagaucaucaccaucggcagcgugucccuggccaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgaccugaaccucaugcccaucuga

SEQ ID NO: 86565 - RNA, 1410 nt, Artificial Sequence
  derived and/or modified sequence opt1 from neuraminidase__InfluenzaA__AID70534
augaaccccaaccagaagaucaucaccaucggcagcgugucccugagcaucuacaucaucugcuucuucaugcagaucgccauccucaucaccacggucacccugcacuucaagcaguacgaguucaacuccccgcccaacaaccaggccaugcccugcgagcccaccaucaucgagcgcaacaucaccgagaucguguaccugacgaacaccaccaucgagaaggagaucugcccgaagcucgcggaguaccggaacuggagcaagccccagugcgacaucaccggguucgcccccuucuccaaggacaacagcauccgccuguccgccggcggggacaucugggugacgcgggagcccuacgucagcugcgacccggacaagugcuaccaguucgcccugggccaggggaccacccucaacaacgugcacuccaacaacaccgugcgcgaccggacgcccuaccgcacccugcugaugaacgagcucggcguccccuuccaccugggcaccaagcaggucugcaucgccuggagcuccagcuccugccacgacgggaaggcguggcugcacgugugcaucaccggcgacgacaagaacgccacggccagcuucaucuacaacgggcggcucguggacuccguggugagcugguccaaggagauccugcgcacccaggagagcgagugcgucugcaucaacgggaccugcaccguggugaugacggacggguccgccagcggcaaggcggacaccaagauccuguucaucgaggagggcaagaucguccacaccagcacccucuccgggagcgcccagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacacgccccggaagaacgacuccagcuccagcucccacugccuggaccccaacaacgaggagggcggccacggggugaagggcugggccuucgacgacgggaacgacgucuggaugggccgcaccaucaacgagaccagccggcucggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcugauccgcgggcggaaggaggagacggaggugcucuggaccagcaacuccaucguggucuucugcggcaccagcgggaccuacggcacgggguccuggccggacggcgccgaccugaaccugaugcccaucuga

SEQ ID NO: 86566 - RNA, 1410 nt, Artificial Sequence
  derived and/or modified sequence opt1 from neuraminidase__InfluenzaA__AID70535
augaaccccaaccagaagaucaucaccaucggcagcgugucccuggccaugugcaccaucugcuucuucaugcagaucgccauccucaucacgaccgucacccugcacuucaagcaguacgaguucaacagcccgcccaacaaccaggcgaugcccugcgagcccaccaucaucgagcgcaacaucacggagaucguguaccugaccaacaccaccaucgagaaggagaucugcccgaagcucgccgaguaccggaacugguccaagccccagugcgacaucacgggguucgcccccuucagcaaggacaacuccauccgccugagcgccggcggggacaucugggugacccgggagcccuacgucuccugcgacccggacaagugcuaccaguucgcccugggccaggggaccacccucaacaacgugcacagcaacaacacggugcgcgaccggacccccuaccgcacccugcugaugaacgagcucggcguccccuuccaccugggcaccaagcaggucugcaucgcgugguccagcuccagcugccacgacgggaaggccuggcugcacgugugcaucacgggcgacgacaagaacgccaccgccuccuucaucuacaacgggcggcucguggacagcgugguguccuggagcaaggagauccugcgcacccaggaguccgagugcgucugcaucaacgggaccugcacgguggugaugaccgacgggagcgcguccggcaaggccgacaccaagauccuguucaucgaggagggcaagaucguccacaccagcacgcucagcggguccgcccagcacguggaggagugcagcugcuacccccgguacccgggcgugcgcugcgucugccgggacaacuggaagggguccaaccgccccaucguggacaucaacaucaaggaccacagcaucguguccagcuacgucugcuccggccuggugggcgacacgccccggaagaacgacagcuccagcuccagccacugccuggaccccaacaacgaggagggcggccacggggugaagggcugggccuucgacgacgggaacgacgucuggaugggccgcaccaucaacgagaccucccggcucggcuacgagaccuucaaggugaucgagggguggagcaacccgaaguccaagcugcagaucaaccgccaggucaucguggaccggggcaaccgcagcggguacuccggcaucuucagcguggaggggaaguccugcaucaaccggugcuucuacgucgagcugauccgcggccggaaggaggagaccgaggugcucuggaccagcaacagcaucguggucuucugcggcaccuccgggacguacggcaccgggagcuggcccgacggcgccgaccugaaccugaugcccaucuga

SEQ ID NO: 86567 - RNA, 1410 nt, Artificial Sequence
  derived and/or modified sequence opt1 from neuraminidase__InfluenzaA__AID70536
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgaccgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 86568 - RNA, 1410 nt, Artificial Sequence; identical to SEQ ID NO: 80526
  derived and/or modified sequence opt1 from neuraminidase__InfluenzaA__AID70537

SEQ ID NO: 86569 - RNA, 1410 nt, Artificial Sequence
  derived and/or modified sequence opt1 from neuraminidase__InfluenzaA__AID70538
augaaccccaaccagaagaagaucaccaucggcgccgugagccugaccaugugcacggucugcaucuucaugcagaucgccauccucaucaccaccgugacccugcacuuccgccaguacgaguucaacuccccgcccaacaaccaggugaugcugugcgagcccacgaucaucgagcggaacaucaccgagaucgucuaccucaccaacaccacgaucgagaaggagaucugccccaagcuggcggaguaccgcaacuggagcaagccgcagugcgacaucaccggguucgcccccuucuccaaggacaacagcauccggcuguccgccggcggggacaucugggugacccgcgagcccuacgugagcugcgaccccgacaagugcuaccaguucgcccucggccaggggaccacgcugaacaacguccacuccaacaacaccgugcgggaccgcaccccguaccggacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcgccugguggacuccgucgugagcugguccaaggagauccugcggacccaggagagcgagugcgugugcaucaacggcacgugcaccgucgugaugaccgacggguccgccagcggcaaggcggacaccaagauccucuucaucgaggagggcaagaucgugcacacguccacccugagcgggagcgcccagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccuccaacagcaucgugguguucugcggcacgagcgggaccuacggcaccggguccuggccggacggcgccgaccugaaccucaugcccaucuga

SEQ ID NO: 86570 - RNA, 1410 nt, Artificial Sequence
  derived and/or modified sequence opt1 from neuraminidase__InfluenzaA__AID70539
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucaaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 86571 - RNA, 1410 nt, Artificial Sequence; identical to SEQ ID NO: 80526
  derived and/or modified sequence opt1 from neuraminidase__InfluenzaA__AID70540

SEQ ID NO: 86572 - RNA, 1410 nt, Artificial Sequence; identical to SEQ ID NO: 80526
  derived and/or modified sequence opt1 from neuraminidase__InfluenzaA__AID70541

SEQ ID NO: 86573 - RNA, 1410 nt, Artificial Sequence
  derived and/or modified sequence opt1 from neuraminidase__InfluenzaA__AID70633
augaaccccaaccagaagaucaucaccaucggcagcgugugcaugaccaucgggauggccaaccugauccuccagaucggcaacaucaucuccaucugggucagccacuccauccagcuggggaaccagagccagaucgaggccugcaaccaguccgugaucacguacgagaacaacaccugggugaaccagaccuacgucaacaucagcaacaccaacuucgcggccggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccgucgcguggagcgccuccgccugccacgacgggaucaacuggcucacgaucggcaucagcggccccgacuccggggccguggcggugcugaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucugggucgagcucauccggggccgccccgaggagaacacgaucuggaccagcggguccagcaucuccuucugcggcgugaacagcgacaccguggggugguccuggcccgacggcgcggagcugccguucaccaucgacaaguga

SEQ ID NO: 86574 - RNA, 1398 nt, Artificial Sequence
  derived and/or modified sequence opt1 from neuraminidase__InfluenzaA__AID70635
augaaccccaagcagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgacggcucccaguaccgcgcgcucaucagcuggccgcuguccagcccgcccaccguguacaacucccggguggagugcaucggguggagcuccaccagcugccacgacggcaagucccgcaugagcaucugcaucagcggccccaacaacaacgccuccgccgucgugugguacaaccggcgccccguggccgagaucaacaccugggcgcggaacauccugcgcacgcaggagagcgagugcgucugccacaacggggugugccccguggucuucaccgacggcuccgccaccgggcccgccgacacccggaucuacuacuucaaggagggcaagauccucaagugggagagccugacgggcaccgccaagcacaucgaggagugcuccugcuacggggagcgcaccggcaucacgugcacgugccgggacaacuggcaggggagcaaccgccccgugauccagaucgacccgguggccaugacccacaccucccaguacaucugcagccccguccugaccgacaacccccggcccaacgacccgaacaucggcaagugcaacgaccccuaccccgggaacaacaacaacggcgugaagggcuucuccuaccucgacggggcgaacaccuggcugggccgcaccaucagcaccgccucccggagcggguacgagaugcugaaggugcccaacgcccucaccgacgaccgcuccaagccgauccagggccagacgaucguccugaacgccgacuggagcggguacuccggcagcuucauggacuacugggccgagggcgacugcuaccgggcgugcuucuacguggagcugauccgcgggcgccccaaggaggacaaggugugguggaccuccaacagcaucgucuccaugugcagcagcaccgaguuccucggccaguggaacuggcccgacggggccaagaucgaguacuuccuguga

SEQ ID NO: 86575 - RNA, 1401 nt, Artificial Sequence
  derived and/or modified sequence opt1 from neuraminidase__InfluenzaA__AIG44695
augaaccccaaccagaagaucaccgccaucggcagcgugucccugaucaucgccaucaucugccuccugaugcagaucgcgauccugaccacgaccaugacccuccacuuccgccagaacgagugcagcaacccguccaacaaccaggucaugcccugcgagcccaucaucaucgagcggaacaccgugcaccugaacagcacgaccaucgagcgcgagaucugccccaagguggccgaguacaagaacugguccaagccgcagugccagaucaccggguucgcccccuucagcaaggacaacuccauccggcugagcgccuccggcgacaucugggucacccgcgagcccuacgugagcugcucccucgacaagugcuaccaguucgcccuggggcagggcacgacccugaagaacaagcacagcaacgggaccacccacgaccggacgccccaccgcacccuccugaugaacgagcugggcgugccguuccaccucggcaccaagcaggucugcaucgcgugguccagcuccagcugcuacgacgggaaggccuggcugcacgugugcgugaccggcgacgacaagaacgccacggccuccaucaucuacgacgggaugcuggucgacagcgugggcuccuggagcaagaacauccuccggacccaggagagcgagugcgugugcaucaacgggaccugcgcggucgugaugaccgacggcuccgccagcggcaaggccgacacgcgcgugcuguucauccgggaggggaagaucaucaacaucagcccccuguccggcuccgcccagcacgucgaggagugcagcugcuacccccgcuaccccgaggugcggugcgugugccgcgacaacuggaagggguccaaccggccgauccucuacaucaacauggccgacuacagcaucgaguccagcuacgucugcuccggccuggugggcgacacgccccgcaacgacgacagcuccagcuccagcaacugccgggaccccaacaacgagcgcggggcgcccggcgugaaggggugggccuucgacgacggcaacgacgucuggauggggcggaccaucaagaacggcucccgcagcggcuacgagaccuuccggguggugaacggguggaccauggccaacuccaagagccagaucaaccgccaggucaucguggacagcgacggcugguccggguacagcggcaucuucuccgucgaggggaagaagugcaucaaccggugcuucuacguggagcugauccgcggccgcccgcaggagccccgggugugguggaccagcaacuccaucaucgucuucugcggcaccagcgggaccuacggcacgggguccuggcccgacggcgccaacaucaacuucaugcccaucuga

SEQ ID NO: 86576 - RNA, 1410 nt, Artificial Sequence
  derived and/or modified sequence opt1 from neuraminidase__InfluenzaA__AIJ10793
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggccaucgaggggugguccaaccccaagagcaagcugcagaccaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggacgagcaacuccaucguggucuucugcggcaccagcgggaccuacggcaccggguccuggccggacggcgccgaccugaaccucaugcccaucuga

SEQ ID NO: 86577 - RNA, 1410 nt, Artificial Sequence; identical to SEQ ID NO: 80526
  derived and/or modified sequence opt1 from neuraminidase__InfluenzaA__AIJ10794

SEQ ID NO: 86578 - RNA, 1410 nt, Artificial Sequence; identical to SEQ ID NO: 82151
  derived and/or modified sequence opt1 from neuraminidase__InfluenzaA__AIJ10795

SEQ ID NO: 86579 - RNA, 1410 nt, Artificial Sequence; identical to SEQ ID NO: 82151
  derived and/or modified sequence opt1 from neuraminidase__InfluenzaA__AIJ10796

SEQ ID NO: 86580 - RNA, 1410 nt, Artificial Sequence
  derived and/or modified sequence opt1 from neuraminidase__InfluenzaA__AIJ10797
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgaggacaagagcugcaucaaccgcugcuucuacguggagcucauccgggggcgcaaggaggagaccgaggugcuguggaccagcaacuccaucgucguguucugcggcacgagcggcaccuacgggaccggcuccuggccggacggggccgaccugaaccucaugcccaucuga

SEQ ID NO: 86581 - RNA, 1410 nt, Artificial Sequence
  derived and/or modified sequence opt1 from neuraminidase__InfluenzaA__AIJ10798
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgaccugaaccucaugcccaucuga

SEQ ID NO: 86582 - RNA, 1410 nt, Artificial Sequence; identical to SEQ ID NO: 82151
  derived and/or modified sequence opt1 from neuraminidase__InfluenzaA__AIJ10799

SEQ ID NO: 86583 - RNA, 1410 nt, Artificial Sequence
  derived and/or modified sequence opt1 from neuraminidase__InfluenzaA__AIJ10800
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggaagcugguggacagcguggucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggcccaucguggacaucaacaucaaggaccacagcaucgucuccagcuacgugugcuccggccuggugggcgacaccccgcgcaagaacgacagcuccagcuccagccacugccucgaccccaacaacgaggagggcgggcacggggucaagggcugggccuucgacgacgggaacgacguguggaugggccggaccaucaacgagacgucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgaccugaaccucaugccgaucuga

SEQ ID NO: 86584 - RNA, 1410 nt, Artificial Sequence; identical to SEQ ID NO: 83154
  derived and/or modified sequence opt1 from neuraminidase__InfluenzaA__AIJ10801

SEQ ID NO: 86585 - RNA, 1410 nt, Artificial Sequence; identical to SEQ ID NO: 83154
  derived and/or modified sequence opt1 from neuraminidase__InfluenzaA__AIJ10803

SEQ ID NO: 86586 - RNA, 1410 nt, Artificial Sequence; identical to SEQ ID NO: 83154
  derived and/or modified sequence opt1 from neuraminidase__InfluenzaA__AIJ10804

SEQ ID NO: 86587 - RNA, 1410 nt, Artificial Sequence; identical to SEQ ID NO: 83154
  derived and/or modified sequence opt1 from neuraminidase__InfluenzaA__AIJ10805

SEQ ID NO: 86588 - RNA, 1410 nt, Artificial Sequence
  derived and/or modified sequence opt1 from neuraminidase__InfluenzaA__AIJ10806
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccaucagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86589 - RNA, 1410 nt, Artificial Sequence
  derived and/or modified sequence opt1 from neuraminidase__InfluenzaA__AIJ10807
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggaggccuacgugagcugcgaccccgacaagugcuaccaguucgcccuggggcagggcaccacgcucaacaacgugcacuccaacaacaccguccgcgaccggaccccguaccgcacccugcugaugaacgagcucggcgugcccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggcggacaccaagauccuguucaucgaggaggggaagaucgugcacacgagcacccucuccggcagcgcccagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggccggacggggccgaccugaaccugaugcccaucuga

SEQ ID NO: 86590 - RNA, 1410 nt, Artificial Sequence
  derived and/or modified sequence opt1 from neuraminidase__InfluenzaA__AIJ10808
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggaggugcugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86591 - RNA, 1410 nt, Artificial Sequence; identical to SEQ ID NO: 83154
  derived and/or modified sequence opt1 from neuraminidase__InfluenzaA__AIJ10809

SEQ ID NO: 86592 - RNA, 1410 nt, Artificial Sequence; identical to SEQ ID NO: 83154
  derived and/or modified sequence opt1 from neuraminidase__InfluenzaA__AIJ10810

SEQ ID NO: 86593 - RNA, 1410 nt, Artificial Sequence
  derived and/or modified sequence opt1 from neuraminidase__InfluenzaA__AIJ10812
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucauggagcgcaacgugaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86594 - RNA, 1410 nt, Artificial Sequence
  derived and/or modified sequence opt1 from neuraminidase__InfluenzaA__AIJ10813
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucauggagcgcaacgugaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaaccccgugcgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccgucgugagcugguccaaggagauccugcgcacccaggagagcgagugcgugugcaucaacgggaccugcacggucgugaugaccgacggcuccgccagcggcaaggccgacaccaagauccuguucaucgaggaggggaagaucgugcacaccagcacgcucuccggcagcgcgcagcacgucgaggagugcuccugcuacccgcgguaccccggggugcgcugcgugugccgggacaacuggaagggcagcaaccgccccaucgucgacaucaacaucaaggaccacuccaucgugagcuccuacgugugcagcggccuggucggggacacgccccggaagaacgacuccagcuccagcucccacugccuggacccgaacaacgaggagggcgggcacggcgugaaggggugggccuucgacgacggcaacgacgucuggaugggccgcaccaucaacgagaccagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggaccagcggcacguacgggaccggcuccuggcccgacggggccgaccugaaccugaugcccaucuga

SEQ ID NO: 86595 - RNA, 1410 nt, Artificial Sequence
  derived and/or modified sequence opt1 from neuraminidase__InfluenzaA__AIJ10814
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucguggagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgacaagggggaccgguccggcuacagcgggaucuucuccguggagggcaagagcugcaucaaccgcugcuucuacguggagcugauccggggccgcaaggaggagaccgagguccucuggaccagcaacuccaucgugguguucugcgggacgagcggcaccuacgggaccggcuccuggcccgacggggccgaccugaaccugaugcccaucuga

SEQ ID NO: 86596 - RNA, 1410 nt, Artificial Sequence
  derived and/or modified sequence opt1 from neuraminidase__InfluenzaA__AIJ10815
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaacgaggugcucuggaccagcaacuccaucgucguguucugcgggaccagcggcacguacgggaccggcuccuggcccgacggggccgaccugaaccugaugcccaucuga

SEQ ID NO: 86597 - RNA, 1410 nt, Artificial Sequence
  derived and/or modified sequence opt1 from neuraminidase__InfluenzaA__AIJ10816
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagggcugcaucaaccggugcuucuacguggagcugauccgcgggcggaaggaggagaccgaggugcucuggaccagcaacagcaucgucguguucugcggcacguccgggaccuacggcaccgggagcuggcccgacggcgccgaccugaaccugaugcccaucuga

SEQ ID NO: 86598 - RNA, 1410 nt, Artificial Sequence; identical to SEQ ID NO: 83154
  derived and/or modified sequence opt1 from neuraminidase__InfluenzaA__AIJ10817

SEQ ID NO: 86599 - RNA, 1410 nt, Artificial Sequence; identical to SEQ ID NO: 83154
  derived and/or modified sequence opt1 from neuraminidase__InfluenzaA__AIJ10818

SEQ ID NO: 86600 - RNA, 1410 nt, Artificial Sequence
  derived and/or modified sequence opt1 from neuraminidase__InfluenzaA__AIJ10819
augaaccccaaccagaagaucaucaccaucggcagcgugucccugaccaucagcacgaucugcuucuucaugcagaucgccauccucaucaccaccgucgcccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggagcaagccccagugcgggaucacgggcuucgcccccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggcguggcugcacgugugcaucacgggggacgacaagaacgccaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggcgaacaccaagauccuguucaucgaggaggggaagaucgugcacaccagcacgcucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 86601 - RNA, 1410 nt, Artificial Sequence; identical to SEQ ID NO: 83154
  derived and/or modified sequence opt1 from neuraminidase__InfluenzaA__AIJ10820

SEQ ID NO: 86602 - RNA, 1410 nt, Artificial Sequence; identical to SEQ ID NO: 83154
  derived and/or modified sequence opt1 from neuraminidase__InfluenzaA__AIJ10821

SEQ ID NO: 86603 - RNA, 1410 nt, Artificial Sequence
  derived and/or modified sequence opt1 from neuraminidase__InfluenzaA__AIJ10822
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaacgaggugcucuggaccagcaacuccaucgucguguucugcgggaccagcggcacguacgggaccggcuccuggcccgacggggccgaccugaaccugaugcccaucuga

SEQ ID NO: 86604 - RNA, 1410 nt, Artificial Sequence
  derived and/or modified sequence opt1 from neuraminidase__InfluenzaA__AIJ10823
augaaccccaaccagaagaucaucaccaucggcagcgugucccugaccaucagcacgaucugcuucuucaugcagaucgccauccucaucaccaccgucacccugcacuucaaccaguacgaguucaacuccccgcccaacaaccaggugaugcugugcgagcccacgaucaucgagcgcaacaucaccgagaucguguaccucaccaccacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuuccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgugacgaagauccuguucaucgaggaggggaagaucgugcacaccagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcggcuacgugugcuccgggcuggucggcgacacgccccggaagaacgacagcuccagcuccagccacugccugaaccccaacaacgaggagggcgggcacggggugaagggcugggccuucgacgacggcaacgacgucuggauggggcgcaccaucaacgagaccucccggcucggcuacgagaccuucaaggugaucgagggguggagcaacccgaaguccaagcugcagaucaaccgccaggugaucgucgaccggggcgaccgcagcggguacuccggcaucuucagcguggagggcaaguccugcaucaaccggugcuucuacguggagcugauccgcgggcggaaggaggagaccgagguccucuggacgagcaacagcaucgugguguucugcggcaccuccgggaccuacggcaccgggagcuggcccgacggcgccgaccugaaccugaugcccaucuga

SEQ ID NO: 86605 - RNA, 1410 nt, Artificial Sequence
  derived and/or modified sequence opt1 from neuraminidase__InfluenzaA__AIJ10824
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86606 - RNA, 1410 nt, Artificial Sequence
  derived and/or modified sequence opt1 from neuraminidase__InfluenzaA__AIJ10827
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccaucgagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86607 - RNA, 1410 nt, Artificial Sequence
  derived and/or modified sequence opt1 from neuraminidase__InfluenzaA__AIJ10828
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccaucgagggcaagagcugcaucaaccggugcuucuacgucgagcugauccgcggccggaaggaggagaccgaggugguguggaccagcaacuccaucgucguguucugcgggacgagcggcaccuacgggaccggcuccuggcccgacggggccgaccucaaccugaugcccaucuga

SEQ ID NO: 86608 - RNA, 1410 nt, Artificial Sequence
  derived and/or modified sequence opt1 from neuraminidase__InfluenzaA__AIJ10829
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaacugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgaccacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccaucgagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 86609 - RNA, 1410 nt, Artificial Sequence
  derived and/or modified sequence opt1 from neuraminidase__InfluenzaA__AIJ10830
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguacaagaacuggagcaagccccagugcgggaucaccggcuucgcgcccuucuccaaggacaacagcauccggcuguccgccgggggcgacaucugggucacccgcgagcccuacgugagcugcgacccggacaagugcuaccaguucgcccuggggcagggcaccacgcucaacaacgugcacuccaacaacaccguccgggaccgcacccccuaccggacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggucagcugguccaaggacauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccaucgagggcaagagcugcaucaaccgcugcuucuacguggagcugauccggggccgcaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86610 - RNA, 1410 nt, Artificial Sequence; identical to SEQ ID NO: 86606
  derived and/or modified sequence opt1 from neuraminidase__InfluenzaA__AIJ10831

SEQ ID NO: 86611 - RNA, 1410 nt, Artificial Sequence; identical to SEQ ID NO: 86606
  derived and/or modified sequence opt1 from neuraminidase__InfluenzaA__AIJ10832

SEQ ID NO: 86612 - RNA, 1410 nt, Artificial Sequence
  derived and/or modified sequence opt1 from neuraminidase__InfluenzaA__AIJ10834
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccaucgagagcaagagcugcaucaaccggugcuucuacgucgagcugauccgcggccggaaggaggagaccgaggugcucuggaccuccaacagcaucguggucuucugcggcacguccgggaccuacggcaccgggagcuggcccgacggcgccgaccugaaccugaugcccaucuga

SEQ ID NO: 86613 - RNA, 1410 nt, Artificial Sequence
  derived and/or modified sequence opt1 from neuraminidase__InfluenzaA__AIJ10835
augaaccccaaccagaagaucaucaccaucggcagcgugucccugaccaucagcacgaucugcuucuucaugcagaucgccauccucaucaccaccgucacccugcacuucaagcaguacgaguucaacuccacgccgaacaaccaggugaugcugugcgagcccaccaucaucgagcgcaacaucaccgagaucguguaccucaccaacacgaccaucgagaaggagaucugccccaagcccgccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccuggggcagggcacgacccucaacaacgugcacuccaacaacaccguccgcgaccggaccccguaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaaccccaagagcaagcugcagaucaaccgccaggugaucguggaccgcggggaccgguccggcuacagcgggaucuucuccaucgagggcaagagcugcaucaaccggugcuucuacgucgagcugauccgcggccggaaggaggagaccgaggugcucuggacgagcaacuccaucguggucuucugcgggaccagcggcaccuacgggaccggcuccuggccggacggggccgaccugaaccugaugcccaucuga

SEQ ID NO: 86614 - RNA, 1410 nt, Artificial Sequence; identical to SEQ ID NO: 86606
  derived and/or modified sequence opt1 from neuraminidase__InfluenzaA__AIJ10836

SEQ ID NO: 86615 - RNA, 1410 nt, Artificial Sequence
  derived and/or modified sequence opt1 from neuraminidase__InfluenzaA__AIJ10837
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucauccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccaucgagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86616 - RNA, 1410 nt, Artificial Sequence; identical to SEQ ID NO: 86606
  derived and/or modified sequence opt1 from neuraminidase__InfluenzaA__AIJ10838

SEQ ID NO: 86617 - RNA, 1410 nt, Artificial Sequence
  derived and/or modified sequence opt1 from neuraminidase__InfluenzaA__AIJ10841
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcgaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccaucgagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 86618 - RNA, 1410 nt, Artificial Sequence
  derived and/or modified sequence opt1 from neuraminidase__InfluenzaA__AIJ10842
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggacauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccgcgguaccccgggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcaucgagggcaaguccugcaucaaccggugcuucuacgucgagcugauccgcggccggaaggaggagaccgaggugcucuggaccagcaacagcaucguggucuucugcgggacguccggcaccuacgggaccggcagcuggcccgacggggccgaccugaaccugaugcccaucuga

SEQ ID NO: 86619 - RNA, 1410 nt, Artificial Sequence; identical to SEQ ID NO: 86606
  derived and/or modified sequence opt1 from neuraminidase__InfluenzaA__AIJ10843

SEQ ID NO: 86620 - RNA, 1410 nt, Artificial Sequence
  derived and/or modified sequence opt1 from neuraminidase__InfluenzaA__AIJ10844
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgugaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcggcuacgugugcuccgggcuggucggcgacaccccgcggaagaacgacagcuccagcuccgggcacugccuggaccccaacaacgaggagggcgggcacggcgugaagggcugggccuucgacgacgggaacgacgucuggaugggccgcaccaucaacgagacgagccggcucggguacgagaccuucaaggugaucaagggcugguccaaccccaagagcaagcugcagaucaaccgccaggugaucgucgaccgcggggaccgguccggcuacagcggcaucuucuccguggagggcaagagcugcaucaaccggugcuucuacguggagcugauccgcgggcggaaggaggagaccgagguccucuggaccuccaacagcaucgugguguucugcgggacgagcggcaccuacgggaccggcuccuggcccgacggcgccgaccugaaccugaugcccaucuga

SEQ ID NO: 86621 - RNA, 1410 nt, Artificial Sequence
  derived and/or modified sequence opt1 from neuraminidase__InfluenzaA__AIJ10845
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuuccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgugaccaagauccuguucaucgaggaggggaagaucgugcacaccagcacgcucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcggcuacgugugcuccgggcuggucggcgacacgccccggaagaacgacagcuccagcuccagccacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggagcaacccgaaguccaagcugcagaucaaccgccaggugaucgucgaccggggcgaccgcagcggguacuccggcaucuucagcguggagggcaaguccugcaucaaccggugcuucuacguggagcugauccgcgggcggaaggaggagaccgagguccucuggaccagcaacagcaucgugguguucugcggcaccuccgggacguacggcaccgggagcuggcccgacggcgccgaccugaaccugaugcccaucuga

SEQ ID NO: 86622 - RNA, 1410 nt, Artificial Sequence
  derived and/or modified sequence opt1 from neuraminidase__InfluenzaA__AIJ10847
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccuucagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcaucgagggcaaguccugcaucaaccggugcuucuacgucgagcugauccgcggccggaaggaggagaccgaggugcucuggaccagcaacagcaucguggucuucugcgggacguccggcaccuacgggaccggcagcuggcccgacggggccgaccugaaccugaugcccaucuga

SEQ ID NO: 86623 - RNA, 1410 nt, Artificial Sequence; identical to SEQ ID NO: 86606
  derived and/or modified sequence opt1 from neuraminidase__InfluenzaA__AIJ10848

SEQ ID NO: 86624 - RNA, 1410 nt, Artificial Sequence
  derived and/or modified sequence opt1 from neuraminidase__InfluenzaA__AIJ10849
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgugaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcggcuacgugugcuccgggcuggucggcgacacgccccggaagaacgacagcuccagcuccagccacugccuggaccccaacaacgaggagggcgggcacggggugaagggcugggccuucgacgacggcaacgacgucuggauggggcgcaccaucaacgagaccucccggcucggcuacgagaccuucaaggugaucgagggguggagcaacccgaaguccaagcugcagaucaaccgccaggugaucgucgaccggggcgaccgcagcggguacuccggcaucuucagcguggagggcaaguccugcaucaaccggugcuucuacguggagcugauccgcgggcggaaggaggagaccgagguccucuggaccagcaacagcaucgugguguucugcggcacguccgggaccuacggcaccgggagcuggcccgacggcgccgaccugaaccugaugcccaucuga

SEQ ID NO: 86625 - RNA, 1410 nt, Artificial Sequence; identical to SEQ ID NO: 86624
  derived and/or modified sequence opt1 from neuraminidase__InfluenzaA__AIJ10851

SEQ ID NO: 86626 - RNA, 1410 nt, Artificial Sequence; identical to SEQ ID NO: 86624
  derived and/or modified sequence opt1 from neuraminidase__InfluenzaA__AIJ10852

SEQ ID NO: 86627 - RNA, 1410 nt, Artificial Sequence; identical to SEQ ID NO: 86620
  derived and/or modified sequence opt1 from neuraminidase__InfluenzaA__AIJ10853

SEQ ID NO: 86628 - RNA, 1410 nt, Artificial Sequence; identical to SEQ ID NO: 86620
  derived and/or modified sequence opt1 from neuraminidase__InfluenzaA__AIJ10854

SEQ ID NO: 86629 - RNA, 1410 nt, Artificial Sequence
  derived and/or modified sequence opt1 from neuraminidase__InfluenzaA__AIJ10855
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuuccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgugaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcggcuacgugugcuccgggcuggucggcgacacgccccggaagaacgacagcuccagcuccagccacugccuggaccccaacaacgaggagggggaccacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcggccggaaggaggagaccgagguccucuggaccagcaacagcaucgugguguucugcgggacguccggcaccuacgggaccggcagcuggcccgacggggccgaccugaaccugaugcccaucuga

SEQ ID NO: 86630 - RNA, 1410 nt, Artificial Sequence
  derived and/or modified sequence opt1 from neuraminidase__InfluenzaA__AIJ10856
augaaccccaacaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaagaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccuucagcuccggccacugccuggaccccaacaacgaggagggcgggcacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccaucgagggcaagagcugcaucaaccggugcuucuacgucgagcugauccgcgggcggaaggaggagaccgaggugcucuggaccuccaacagcaucguggucuucugcggcacgagcgggaccuacggcaccggguccuggcccgacggcgccgaccugaaccugaugcccaucuga

SEQ ID NO: 86631 - RNA, 1410 nt, Artificial Sequence; identical to SEQ ID NO: 86606
  derived and/or modified sequence opt1 from neuraminidase__InfluenzaA__AIJ10857

SEQ ID NO: 86632 - RNA, 1410 nt, Artificial Sequence; identical to SEQ ID NO: 83154
  derived and/or modified sequence opt1 from neuraminidase__InfluenzaA__AIJ29348

SEQ ID NO: 86633 - RNA, 1410 nt, Artificial Sequence; identical to SEQ ID NO: 83154
  derived and/or modified sequence opt1 from neuraminidase__InfluenzaA__AIJ29350

SEQ ID NO: 86634 - RNA, 1410 nt, Artificial Sequence
  derived and/or modified sequence opt1 from neuraminidase__InfluenzaA__AIJ29352
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86635 - RNA, 1410 nt, Artificial Sequence; identical to SEQ ID NO: 82151
  derived and/or modified sequence opt1 from neuraminidase__InfluenzaA__AIJ29354

SEQ ID NO: 86636 - RNA, 1410 nt, Artificial Sequence; identical to SEQ ID NO: 83930
  derived and/or modified sequence opt1 from neuraminidase__InfluenzaA__AIJ29356

SEQ ID NO: 86637 - RNA, 1410 nt, Artificial Sequence; identical to SEQ ID NO: 83930
  derived and/or modified sequence opt1 from neuraminidase__InfluenzaA__AIJ29358

SEQ ID NO: 86638 - RNA, 1410 nt, Artificial Sequence
  derived and/or modified sequence opt1 from neuraminidase__InfluenzaA__AIJ29360
augaaccccaaccagaagaucaucaccaucggcagcgugucccugaccaucagcacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 86639 - RNA, 1410 nt, Artificial Sequence; identical to SEQ ID NO: 83154
  derived and/or modified sequence opt1 from neuraminidase__InfluenzaA__AIJ29362

SEQ ID NO: 86640 - RNA, 1410 nt, Artificial Sequence
  derived and/or modified sequence opt1 from neuraminidase__InfluenzaA__AIL93626
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccuacgugaaccagaccuacgugaacaucagcaacaccaacuucgcggccggccgcuccgucgugagcgugaagcuggccgggaacuccagccucugcccggucuccggcugggccaucuacagcaaggacaacuccgugcggaucggcagcaagggggacguguucgucauccgcgagcccuucaucuccugcagcccccuggagugccggacguucuuccugacccagggcgcccuccugaacgacaagcacuccaacgggaccaucaaggaccgcagccccuaccggacccugauguccugcccgaucggcgaggugcccagccccuacaacagccgcuucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcggacccaggaguccgagugcgccugcgugaacgggagcugcuucacgaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccgugcuguccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugaccggccucgacugcauccgccccugcuucuggguggagcugauccggggccgccccaaggagaacacgaucuggaccuccgggagcuccaucagcuucugcggcgucaacuccgacaccgugggguggagcuggcccgacggcgcggagcugccguucaccaucgacaaguga

SEQ ID NO: 86641 - RNA, 1410 nt, Artificial Sequence
  derived and/or modified sequence opt1 from neuraminidase__InfluenzaA__AIL93648
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggcggaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaacaagcaggucaucguggaccgcggggaccgguccggcuacagcgggaucuucuccguggagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86642 - RNA, 1410 nt, Artificial Sequence; identical to SEQ ID NO: 83154
  derived and/or modified sequence opt1 from neuraminidase__InfluenzaA__AIL93660

SEQ ID NO: 86643 - RNA, 1410 nt, Artificial Sequence; identical to SEQ ID NO: 83154
  derived and/or modified sequence opt1 from neuraminidase__InfluenzaA__AIL93672

SEQ ID NO: 86644 - RNA, 1410 nt, Artificial Sequence
  derived and/or modified sequence opt1 from neuraminidase__InfluenzaA__AIL93684
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuccgcgacgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccagccccuacaacucccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggaagaacaacauccugcgcacgcaggagagcgagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcguguucggggacaacccgcgccccaacgacaagaccggcuccugcggccccgugcugagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcacccggagcugacgggccucgacugcauccggcccugcuucuggaucgagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 86645 - RNA, 1410 nt, Artificial Sequence
  derived and/or modified sequence opt1 from neuraminidase__InfluenzaA__AIL93719
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaacaagcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86646 - RNA, 1410 nt, Artificial Sequence; identical to SEQ ID NO: 86645
  derived and/or modified sequence opt1 from neuraminidase__InfluenzaA__AIL93743

SEQ ID NO: 86647 - RNA, 1410 nt, Artificial Sequence; identical to SEQ ID NO: 86645
  derived and/or modified sequence opt1 from neuraminidase__InfluenzaA__AIL93755

SEQ ID NO: 86648 - RNA, 1410 nt, Artificial Sequence; identical to SEQ ID NO: 83154
  derived and/or modified sequence opt1 from neuraminidase__InfluenzaA__AIL93767

SEQ ID NO: 86649 - RNA, 1410 nt, Artificial Sequence; identical to SEQ ID NO: 83154
  derived and/or modified sequence opt1 from neuraminidase__InfluenzaA__AIL93779

SEQ ID NO: 86650 - RNA, 1410 nt, Artificial Sequence
  derived and/or modified sequence opt1 from neuraminidase__InfluenzaA__AIL93791
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgcggacccucagcggcuccgcgcagcacguggaggagugcagcugcuacccccgcuacccggggguccggugcgugugccgcgacaacuggaagggcuccaaccggcccaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaacaagcaggucaucguggaccgcggggaccggagcggcuacuccgggaucuucagcguggagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86651 - RNA, 1410 nt, Artificial Sequence; identical to SEQ ID NO: 86645
  derived and/or modified sequence opt1 from neuraminidase__InfluenzaA__AIL93803

SEQ ID NO: 86652 - RNA, 1410 nt, Artificial Sequence
  derived and/or modified sequence opt1 from neuraminidase__InfluenzaA__AIL93815
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucuacagcuacgugugcuccggccuggugggggacacgccccggaagaacgacagcuccagcuccagccacugccugaaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86653 - RNA, 1410 nt, Artificial Sequence; identical to SEQ ID NO: 83154
  derived and/or modified sequence opt1 from neuraminidase__InfluenzaA__AIL93827

SEQ ID NO: 86654 - RNA, 1410 nt, Artificial Sequence
  derived and/or modified sequence opt1 from neuraminidase__InfluenzaA__AIL93839
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 86655 - RNA, 1410 nt, Artificial Sequence
  derived and/or modified sequence opt1 from neuraminidase__InfluenzaA__AIL93850
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaagggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 86656 - RNA, 1410 nt, Artificial Sequence; identical to SEQ ID NO: 86645
  derived and/or modified sequence opt1 from neuraminidase__InfluenzaA__AIL93861

SEQ ID NO: 86657 - RNA, 1410 nt, Artificial Sequence
  derived and/or modified sequence opt1 from neuraminidase__InfluenzaA__AIL93885
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcggggucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 86658 - RNA, 1410 nt, Artificial Sequence; identical to SEQ ID NO: 86645
  derived and/or modified sequence opt1 from neuraminidase__InfluenzaA__AIL93897

SEQ ID NO: 86659 - RNA, 1410 nt, Artificial Sequence
  derived and/or modified sequence opt1 from neuraminidase__InfluenzaA__AIL93909
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacuccggggccguggccguccugaaguacaacggcaucaucaccgacaccaucaagagcuggcgcaacaacauccugcggacgcaggaguccgagugcgugugcgugaacgggagcugcuucaccaucaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 86660 - RNA, 1410 nt, Artificial Sequence; identical to SEQ ID NO: 86645
  derived and/or modified sequence opt1 from neuraminidase__InfluenzaA__AIL93920

SEQ ID NO: 86661 - RNA, 1410 nt, Artificial Sequence
  derived and/or modified sequence opt1 from neuraminidase__InfluenzaA__AIL93943
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagccccuccgagugccgcaccuucuuccugacccagggcgcccugcucaacgacaagcacagcaacgggaccaucaaggaccggucccccuaccgcacgcugaugagcugcccgaucggcgaggugcccagccccuacaacucccgguucgagagcgucgccugguccgcgagcgccugccacgacgggaucaacuggcugaccaucggcaucuccggccccgacagcggggccguggccgugcucaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcguguucggggacaacccgcggcccaacgacaagaccggcuccugcggccccgucagcagcaacggggccaacggcgugaagggguucuccuucaaguacggcaacgggguguggaucggccgcaccaagagcaucuccagccggaagggcuucgagaugaucugggaccccaacggguggaccggcaccgacaacaacuucuccaucaagcaggacaucgucgggaucaaggaguggagcggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgugggguggagcuggcccgacggcgccgagcucccguucacgaucgacaaguga

SEQ ID NO: 86662 - RNA, 1410 nt, Artificial Sequence; identical to SEQ ID NO: 86645
  derived and/or modified sequence opt1 from neuraminidase__InfluenzaA__AIL93954

SEQ ID NO: 86663 - RNA, 1410 nt, Artificial Sequence; identical to SEQ ID NO: 86645
  derived and/or modified sequence opt1 from neuraminidase__InfluenzaA__AIL93966

SEQ ID NO: 86664 - RNA, 1410 nt, Artificial Sequence
  derived and/or modified sequence opt1 from neuraminidase__InfluenzaA__AIL93978
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 86665 - RNA, 1410 nt, Artificial Sequence; identical to SEQ ID NO: 86654
  derived and/or modified sequence opt1 from neuraminidase__InfluenzaA__AIL93990

SEQ ID NO: 86666 - RNA, 1410 nt, Artificial Sequence; identical to SEQ ID NO: 83154
  derived and/or modified sequence opt1 from neuraminidase__InfluenzaA__AIL94001

SEQ ID NO: 86667 - RNA, 1410 nt, Artificial Sequence; identical to SEQ ID NO: 86645
  derived and/or modified sequence opt1 from neuraminidase__InfluenzaA__AIL94013

SEQ ID NO: 86668 - RNA, 1410 nt, Artificial Sequence; identical to SEQ ID NO: 86645
  derived and/or modified sequence opt1 from neuraminidase__InfluenzaA__AIL94025

SEQ ID NO: 86669 - RNA, 1410 nt, Artificial Sequence; identical to SEQ ID NO: 86645
  derived and/or modified sequence opt1 from neuraminidase__InfluenzaA__AIL94037

SEQ ID NO: 86670 - RNA, 1410 nt, Artificial Sequence; identical to SEQ ID NO: 86645
  derived and/or modified sequence opt1 from neuraminidase__InfluenzaA__AIL94049

SEQ ID NO: 86671 - RNA, 1410 nt, Artificial Sequence; identical to SEQ ID NO: 86654
  derived and/or modified sequence opt1 from neuraminidase__InfluenzaA__AIL94061

SEQ ID NO: 86672 - RNA, 1410 nt, Artificial Sequence
  derived and/or modified sequence opt1 from neuraminidase__InfluenzaA__AIL94072
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccgugcuguccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggagcggcuacuccgggagcuucguccagcacccggagcugacgggccucgacugcauccggcccugcuucuggaucgagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 86673 - RNA, 1410 nt, Artificial Sequence; identical to SEQ ID NO: 86654
  derived and/or modified sequence opt1 from neuraminidase__InfluenzaA__AIL94083

SEQ ID NO: 86674 - RNA, 1410 nt, Artificial Sequence; identical to SEQ ID NO: 86645
  derived and/or modified sequence opt1 from neuraminidase__InfluenzaA__AIL94238

SEQ ID NO: 86675 - RNA, 1410 nt, Artificial Sequence
  derived and/or modified sequence opt1 from neuraminidase__InfluenzaA__AIL94250
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccgaacgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcguguucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggagcggcuacuccgggagcuucguccagcacccggagcugaccggccuggacugcauccggcccugcuucuggguggagcucauccgcggccggcccaaggagaacacgaucuggaccuccgggagcuccaucagcuucugcggcgucaacuccgacaccgugggguggagcuggcccgacggcgcggagcugccguucaccaucgacaaguga

SEQ ID NO: 86676 - RNA, 1410 nt, Artificial Sequence; identical to SEQ ID NO: 83154
  derived and/or modified sequence opt1 from neuraminidase__InfluenzaA__AIL94261

SEQ ID NO: 86677 - RNA, 1410 nt, Artificial Sequence; identical to SEQ ID NO: 83154
  derived and/or modified sequence opt1 from neuraminidase__InfluenzaA__AIL94273

SEQ ID NO: 86678 - RNA, 1410 nt, Artificial Sequence; identical to SEQ ID NO: 83154
  derived and/or modified sequence opt1 from neuraminidase__InfluenzaA__AIL94285

SEQ ID NO: 86679 - RNA, 1410 nt, Artificial Sequence
  derived and/or modified sequence opt1 from neuraminidase__InfluenzaA__AIL94297
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgcggacccucagcggcuccgcgcagcacguggaggagugcagcugcuacccccgcuacccggggguccggugcgugugccgcgacaacuggaagggcuccaaccggcccaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaacaagcaggucaucguggaccgcggggaccggagcggcuacuccgggaucuucagcguggagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86680 - RNA, 1410 nt, Artificial Sequence; identical to SEQ ID NO: 86645
  derived and/or modified sequence opt1 from neuraminidase__InfluenzaA__AIL94309

SEQ ID NO: 86681 - RNA, 1410 nt, Artificial Sequence; identical to SEQ ID NO: 86664
  derived and/or modified sequence opt1 from neuraminidase__InfluenzaA__AIL94321

SEQ ID NO: 86682 - RNA, 1410 nt, Artificial Sequence; identical to SEQ ID NO: 83154
  derived and/or modified sequence opt1 from neuraminidase__InfluenzaA__AIL94368

SEQ ID NO: 86683 - RNA, 1410 nt, Artificial Sequence
  derived and/or modified sequence opt1 from neuraminidase__InfluenzaA__AIL94380
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccguggucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaacaagcaggucaucguggaccgcggggaccgguccggcuacagcgggaucuucuccguggagggcaagagcugcaucaaccgcugcuucuacguggagcugauccggggccgcaaggaggagaccgagguccucuggaccagcaacuccaucgugguguucugcgggacgagcggcaccuacgggaccggcuccuggcccgacggggccgaccugaaccugaugcccaucuga

SEQ ID NO: 86684 - RNA, 1410 nt, Artificial Sequence
  derived and/or modified sequence opt1 from neuraminidase__InfluenzaA__AIL94392
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacacgaucuggaccagcggguccagcaucuccuucugcggcgucaacagcgacaccguggggugguccuggcccgacggcgcggagcugccguucaccaucgacaaguga

SEQ ID NO: 86685 - RNA, 1410 nt, Artificial Sequence
  derived and/or modified sequence opt1 from neuraminidase__InfluenzaA__AIL94403
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcgaccccguguccagcaacggcgccaacggggucaagggcuucagcuucaaguacgggaacggcguguggaucgggcggaccaaguccaucagcucccgcaagggcuucgagaugaucugggaccccaacggcuggaccgggaccgacaacaacuucagcaucaagcaggacaucgugggcaucaacgagugguccggguacagcggcuccuucguccagcacccggagcugaccgggcuggacugcauccggcccugcuucuggguggagcucauccgcggccggcccaaggagaacacgaucuggaccagcggcuccagcaucuccuucugcggggucaacagcgacaccgugggcugguccuggcccgacggggcggagcugccguucaccaucgacaaguga

SEQ ID NO: 86686 - RNA, 1410 nt, Artificial Sequence; identical to SEQ ID NO: 83154
  derived and/or modified sequence opt1 from neuraminidase__InfluenzaA__AIL94426

SEQ ID NO: 86687 - RNA, 1410 nt, Artificial Sequence
  derived and/or modified sequence opt1 from neuraminidase__InfluenzaA__AIL94438
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcgacgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccgugagcucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 86688 - RNA, 1410 nt, Artificial Sequence
  derived and/or modified sequence opt1 from neuraminidase__InfluenzaA__AIL94449
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucuacagcuacgugugcuccggccuggugggggacacgccccggaagaacgacagcuccagcuccagccacugccugaaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86689 - RNA, 1410 nt, Artificial Sequence; identical to SEQ ID NO: 86683
  derived and/or modified sequence opt1 from neuraminidase__InfluenzaA__AIL94461

SEQ ID NO: 86690 - RNA, 1410 nt, Artificial Sequence
  derived and/or modified sequence opt1 from neuraminidase__InfluenzaA__AIL94473
augaaccccaaccagaagaucaucaccaucggcagcgugugcaugaccaucgggauggccaaccugauccuccagaucggcaacaucaucuccaucugggucgggcacagcauccagcugggcaaccagucccagaucgagacgugcaaccagagcgugaucaccuacgagaacaacaccugggugaaccagaccuacgucaacaucuccaacacgaacuucgccgcggggcagagcguggugccggucaagcuggccggcaacuccagccucugccccguguccggcugggccaucuacagcaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggagcccguaccgcacgcugauguccugccccaucggggaggugcccagccccuacaacucccgguucgagagcgucgccuggagcgcguccgccugccacgacggcaucaacuggcucaccaucggcaucagcgggccggacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacggccccuccgacgggcaggccagcuacaagaucuuccgcaucgagaagggcaagaucgugaaguccguggagaugaacacccccaacuaccacuacgaggagugcagcugcuaccccgacuccagcgagaucacgugcgucugccgggacaacuggcacggguccaaccgcccgugggugagcuucaaccagaaccucgaguaccagaucggcuacaucugcuccgggguguucggcgacaacccccggcccaacgacaagaccggcagcugcgggcccgucuccagcaacggcgccaacggggugaagggcuucuccuucaaguacgggaacggcguguggaucggccgcaccaagagcaucagcucccggaagggguucgagaugaucugggacccgaacggcuggaccgggacggacaacaacuucagcaucaagcaggacaucgucggcaucaaggagugguccggguacagcggcuccuucgugcagcaccccgagcugaccggccuggacugcauccgccccugcuucugggucgagcucauccgggggcgccccgaggagaacaccaucuggaccagcggcuccagcaucuccuucugcggggugaacagcgacaucgugggcugguccuggccggacggcgccgagcugcccuucacgaucgacaaguga

SEQ ID NO: 86691 - RNA, 1410 nt, Artificial Sequence; identical to SEQ ID NO: 85744
  derived and/or modified sequence opt1 from neuraminidase__InfluenzaA__AIL94484

SEQ ID NO: 86692 - RNA, 1410 nt, Artificial Sequence; identical to SEQ ID NO: 86654
  derived and/or modified sequence opt1 from neuraminidase__InfluenzaA__AIL94507

SEQ ID NO: 86693 - RNA, 1410 nt, Artificial Sequence
  derived and/or modified sequence opt1 from neuraminidase__InfluenzaA__AIL94518
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaacaagcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugagccugaugcccaucuga

SEQ ID NO: 86694 - RNA, 1410 nt, Artificial Sequence
  derived and/or modified sequence opt1 from neuraminidase__InfluenzaA__AIL94530
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccugaaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86695 - RNA, 1410 nt, Artificial Sequence; identical to SEQ ID NO: 86684
  derived and/or modified sequence opt1 from neuraminidase__InfluenzaA__AIL94542

SEQ ID NO: 86696 - RNA, 1410 nt, Artificial Sequence; identical to SEQ ID NO: 86654
  derived and/or modified sequence opt1 from neuraminidase__InfluenzaA__AIL94553

SEQ ID NO: 86697 - RNA, 1410 nt, Artificial Sequence; identical to SEQ ID NO: 86645
  derived and/or modified sequence opt1 from neuraminidase__InfluenzaA__AIL94564

SEQ ID NO: 86698 - RNA, 1410 nt, Artificial Sequence; identical to SEQ ID NO: 86654
  derived and/or modified sequence opt1 from neuraminidase__InfluenzaA__AIL94576

SEQ ID NO: 86699 - RNA, 1410 nt, Artificial Sequence
  derived and/or modified sequence opt1 from neuraminidase__InfluenzaA__AIL94587
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagauggacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggacgaaguccaucagcucccgcaagggcuucgagaugaucugggaccccaacggguggaacggcaccgacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacaccaucuggaccgggggcagcuccaucagcuucugcggggucaacuccgacaccgugggcuggagcuggcccgacggcgcggagcugccguucaccaucgacaaguga

SEQ ID NO: 86700 - RNA, 1410 nt, Artificial Sequence; identical to SEQ ID NO: 86684
  derived and/or modified sequence opt1 from neuraminidase__InfluenzaA__AIL94598

SEQ ID NO: 86701 - RNA, 1410 nt, Artificial Sequence
  derived and/or modified sequence opt1 from neuraminidase__InfluenzaA__AIL94609
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugagcgagcugggcgugcccuuccaccuggggacgaagcaggucugcaucgccugguccagcuccagcugccacgacggcaaggccuggcuccacgugugcaucaccggggacgacaagaacgcgaccgccuccuucaucuacaacggccggcugguggacagcguggucuccuggagcaaggagauccugcgcacccaggaguccgagugcgugugcaucaacgggacgugcaccguggucaugaccgacggcagcgccagcggcaaggccgacaccaagauccucuucaucgaggaggggaagaucgugcacacguccacccugagcggcuccgcgcagcacguggaggagugcagcugcuacccccuguacccggggguccggugcgugugccgcgacaacuggaagggcuccaaccggcccaucguggacaucaacaucaaggaccacagcaucgucuccagcuacgugugcuccggccucgugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccugggguacgagaccuucaaggucaucgagggcuggagcaacccgaaguccaagcuccagaucaaccggcaggucaucguggaccgcggggaccggagcggcuacuccgggaucuucagcguggagggcaagagcugcaucaaccgcugcuucuacguggagcugauccggggccgcaaggaggagaccgaggugcuguggaccuccaacagcaucgucguguucugcgggacguccggcaccuacgggaccggcagcuggcccgacggggccgaccucaaccugaugcccaucuga

SEQ ID NO: 86702 - RNA, 1410 nt, Artificial Sequence
  derived and/or modified sequence opt1 from neuraminidase__InfluenzaA__AIL94621
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugccggugaagcuggccgggaacagcucccucugccccgucagcggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccgguccccguaccgcacccugaugagcugccccaucggcgaggugcccucccccuacaacagccgguucgagagcguggcgugguccgccagcgccugccacgacgggaucaacuggcucacgaucggcaucuccggcccggacagcggggccgucgcggugcugaaguacaacggcaucaucaccgacaccaucaaguccuggaagaacaacauccugcgcacccaggagagcgagugcgccugcgugaacggguccugcuucacgaucaugaccgacggccccagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccgugggucuccuucaaccagaaccucgaguaccagaucggguacaucugcagcggcguguucggggacaacccccgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggacccgaacggguggaccggcaccgacaacgacuucuccaucaagcaggacaucguggggaucaacgaguggagcggcuacuccgggagcuucguccagcaccccgagcugaccggccuggacugcauccggcccugcuucuggguggagcucauccgcggccggcccaaggagaacacgaucuggaccuccgggagcuccaucagcuucugcggcgucaacuccgacaccgugggguggagcuggccggacggcgcggagcugcccuucaccaucgacaaguga

SEQ ID NO: 86703 - RNA, 1410 nt, Artificial Sequence; identical to SEQ ID NO: 86654
  derived and/or modified sequence opt1 from neuraminidase__InfluenzaA__AIL94632

SEQ ID NO: 86704 - RNA, 1410 nt, Artificial Sequence; identical to SEQ ID NO: 83154
  derived and/or modified sequence opt1 from neuraminidase__InfluenzaA__AIL94643

SEQ ID NO: 86705 - RNA, 1410 nt, Artificial Sequence
  derived and/or modified sequence opt1 from neuraminidase__InfluenzaA__AIL94655
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacuccggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86706 - RNA, 1410 nt, Artificial Sequence
  derived and/or modified sequence opt1 from neuraminidase__InfluenzaA__AIL94677
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugccggugaagcuggccgggaacagcucccucugccccgucagcggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccgguccccguaccgcacccugaugagcugccccaucggcgaggugcccucccccuacaacagccgguucgagagcguggcgugguccgccagcgccugccacgacgggaucaacuggcucacgaucggcaucuccggcccggacagcggggccgucgcggugcugaaguacaacggcaucaucaccgacaccaucaaguccuggaagaacaacauccugcgcacccaggagagcgagugcgccugcgugaacggguccugcuucacgaucaugaccgacggccccagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccgugggucuccuucaaccagaaccucgaguaccagaucggguacaucugcagcggcguguucggggacaacccccgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggacccgaacggguggaccggcaccgacaacaacuucuccaucaagcaggacaucguggggaucaacgaguggagcggcuacuccgggagcuucguccagcaccccgagcugaccggccuggacugcauccggcccugcuucuggguggagcucauccgcggccggcccaaggagaacacgaucuggaccuccgggagcuccaucagcuucugcggcgucaacuccgacaccgugggguggagcuggccggacggcgcggagcugcccuucaccaucgacaaguga

SEQ ID NO: 86707 - RNA, 1410 nt, Artificial Sequence; identical to SEQ ID NO: 86645
  derived and/or modified sequence opt1 from neuraminidase__InfluenzaA__AIL94688

SEQ ID NO: 86708 - RNA, 1410 nt, Artificial Sequence
  derived and/or modified sequence opt1 from neuraminidase__InfluenzaA__AIL94700
augaaccccaaccagaagaucaucaccaucggcagcgugucccugaccaucagcacgaucugcuucuucaugcagaucgccauccucaucaccaucgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgacaccaagauccuguucaucgaggaggggaagaucgugcacaucagcacccucuccggcagcgcgcagcacguggaggagugcuccugcuacccccgguacccggggguccgcugcgugugccgggacaacuggaagggcagcaaccgccccaucguggacaucaacaucgaggaccacuccaucgucagcuccuacgugugcagcggccuggugggggacacgccccggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagacggaggugcucuggaccagcaacuccaucgucguguucugcgggaccagcggcaccuacgggacgggcuccuggccggacggggccgaccugaaccugaugcccaucuga

SEQ ID NO: 86709 - RNA, 1410 nt, Artificial Sequence; identical to SEQ ID NO: 86654
  derived and/or modified sequence opt1 from neuraminidase__InfluenzaA__AIL94712

SEQ ID NO: 86710 - RNA, 1410 nt, Artificial Sequence; identical to SEQ ID NO: 86684
  derived and/or modified sequence opt1 from neuraminidase__InfluenzaA__AIL94723

SEQ ID NO: 86711 - RNA, 1410 nt, Artificial Sequence
  derived and/or modified sequence opt1 from neuraminidase__InfluenzaA__AIL94734
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgagcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacaucagcacgcucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagacguucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggaccagcggcacguacgggaccggcuccuggcccgacggggccgaccugaaccugaugcccaucuga

SEQ ID NO: 86712 - RNA, 1410 nt, Artificial Sequence; identical to SEQ ID NO: 86654
  derived and/or modified sequence opt1 from neuraminidase__InfluenzaA__AIL94746

SEQ ID NO: 86713 - RNA, 1410 nt, Artificial Sequence; identical to SEQ ID NO: 86684
  derived and/or modified sequence opt1 from neuraminidase__InfluenzaA__AIL94757

SEQ ID NO: 86714 - RNA, 1410 nt, Artificial Sequence; identical to SEQ ID NO: 86645
  derived and/or modified sequence opt1 from neuraminidase__InfluenzaA__AIL94768

SEQ ID NO: 86715 - RNA, 1410 nt, Artificial Sequence; identical to SEQ ID NO: 83154
  derived and/or modified sequence opt1 from neuraminidase__InfluenzaA__AIL94780

SEQ ID NO: 86716 - RNA, 1410 nt, Artificial Sequence; identical to SEQ ID NO: 86684
  derived and/or modified sequence opt1 from neuraminidase__InfluenzaA__AIL94803

SEQ ID NO: 86717 - RNA, 1410 nt, Artificial Sequence; identical to SEQ ID NO: 86664
  derived and/or modified sequence opt1 from neuraminidase__InfluenzaA__AIL94814

SEQ ID NO: 86718 - RNA, 1410 nt, Artificial Sequence
  derived and/or modified sequence opt1 from neuraminidase__InfluenzaA__AIL94826
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacaacaccgcccgcgaccggaccccguaccgcacccugcucaugaacgagcugggcguccccuuccaccuggggacgaagcaggucugcaucgccuggagcuccagcuccugccacgacggcaaggcguggcuccacgugugcaucaccggggacgacaagaacgccaccgccagcuucaucuacaacggccggcugguggacuccguggugagcugguccaaggagauccugcgcacccaggagagcgagugcgucugcaucaacgggacgugcaccguggugaugaccgacggcuccgccagcggcaaggcggacaccaagauccucuucaucgaggaggggaagaucguccacacgagcacccuguccggcagcgcccagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucaaccccaacaacgaggagggcgggcacggcgugaaggggugggccuucgacgacggcaacgacgucuggaugggccgcaccaucaacgagaccagccggcugggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgaccugaaccucaugcccaucuga

SEQ ID NO: 86719 - RNA, 1410 nt, Artificial Sequence
  derived and/or modified sequence opt1 from neuraminidase__InfluenzaA__AIL94850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcuguucgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucaaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacagcgaggagggcgggcacggggugaagggcugggccuucgacgacgggaacgacgucuggaugggccgcaccaucuccgagaagucccggcugggcuacgagaccuucaaggugaucgagggguggagcaaccccaagagcaaguuccagaucaaccgccaggucaucguggaccggggcaaccgcuccggguacagcggcaucuucagcguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgaccugaaccugaugcccaucuga

SEQ ID NO: 86720 - RNA, 1410 nt, Artificial Sequence; identical to SEQ ID NO: 80418
  derived and/or modified sequence opt1 from neuraminidase__InfluenzaA__AIL94862

SEQ ID NO: 86721 - RNA, 1410 nt, Artificial Sequence; identical to SEQ ID NO: 80418
  derived and/or modified sequence opt1 from neuraminidase__InfluenzaA__AIL94874

SEQ ID NO: 86722 - RNA, 1410 nt, Artificial Sequence
  derived and/or modified sequence opt1 from neuraminidase__InfluenzaA__AIL94886
augaaccccaaccagaagaucaucaccaucggcagcgugugcaugaccaucgggauggccaaccugaugcuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagaucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacgacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggccccacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 86723 - RNA, 1410 nt, Artificial Sequence; identical to SEQ ID NO: 83930
  derived and/or modified sequence opt1 from neuraminidase__InfluenzaA__AIL94897

SEQ ID NO: 86724 - RNA, 1410 nt, Artificial Sequence; identical to SEQ ID NO: 86718
  derived and/or modified sequence opt1 from neuraminidase__InfluenzaA__AIL94909

SEQ ID NO: 86725 - RNA, 1410 nt, Artificial Sequence; identical to SEQ ID NO: 83154
  derived and/or modified sequence opt1 from neuraminidase__InfluenzaA__AIL94921

SEQ ID NO: 86726 - RNA, 1410 nt, Artificial Sequence; identical to SEQ ID NO: 83154
  derived and/or modified sequence opt1 from neuraminidase__InfluenzaA__AIL94933

SEQ ID NO: 86727 - RNA, 1410 nt, Artificial Sequence; identical to SEQ ID NO: 86645
  derived and/or modified sequence opt1 from neuraminidase__InfluenzaA__AIL94945

SEQ ID NO: 86728 - RNA, 1410 nt, Artificial Sequence
  derived and/or modified sequence opt1 from neuraminidase__InfluenzaA__AIL94957
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccaguccgucaucacguacgagaacaacaccugggugaaccagaccuacgugaacaucagcaacaccaacuucgcggccggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccguggcguggagcgccuccgccugccacgacgggaucaacuggcucacgaucggcaucagcggccccgacuccggggccgucgcggugcugaaguacaacggcaucaucaccgacaccaucaagagcuggaagaacaacauccugcgcacccaggaguccgagugcgccugcgugaacgggagcugcuucacgaucaugaccgacggcccguccgacggccaggccagcuacaagaucuuccggaucgagaaggggaagaucgucaaguccguggagauggacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaacggcaccgacaacaacuucagcaucaagcaggacaucguggggaucaacgagugguccggcuacagcggguccuucguccagcacccggagcugaccggccuggacugcauccggcccugcuucuggguggagcucauccgcggccggcccaaggagaacaccaucuggacgagcggguccagcaucuccuucugcggcgucaacagcgacaccguggggugguccuggcccgacggcgcggagcugccguucaccaucgacaaguga

SEQ ID NO: 86729 - RNA, 1410 nt, Artificial Sequence; identical to SEQ ID NO: 86718
  derived and/or modified sequence opt1 from neuraminidase__InfluenzaA__AIL94968

SEQ ID NO: 86730 - RNA, 1410 nt, Artificial Sequence
  derived and/or modified sequence opt1 from neuraminidase__InfluenzaA__AIM55840
augaaccccaaccagaagaucaucaccaucggcagcgugugcaugaccaucgggauggccaaccugauccuccagaucggcaacaucaucuccaucuggaucagccacuccauccaggucgggaaccagagccagaucgagaucugcaaccaguccgugaucacguacgagaacaacaccugggugaaccagaccuacgucaacaucagcaacaccaacuucgccgcgggccagccggugguguccgucaagcuggccgggaacagcucccugugccccgugagcggcugggccaucuacuccaaggacaacagcgugcgcaucggcuccaagggggacgucuucgugauccgggagcccuucaucagcugcagcccccucgagugccgcacguucuuccugacccagggcgcccugcucaacgacaagcacagcaacgggaccaucaaggaccgguccccguaccgcacccugaugagcugccccaucggcgaggugcccucccccuacaacagccgguucgagagcgucgccugguccgcgagcgccugccacgacgggaucaacuggcugacgaucggcaucuccggcccggacagcggggccguggccgugcucaaguacaacggcaucaucaccgacaccaucaaguccuggcgcaacgacauccugcggacccaggagagcgagugcgcgugcgucaacggguccugcuucacgaucaugaccgacggccccagcgacggccaggccuccuacaagaucuuccgcaucgagaaggggaagaucgugaaguccguggagaugaacgcccccaacuaccacuucgaggagugcuccugcuaccccgacagcuccgagaucacgugcgucugccgggacaacuggcacggcagcaaccgcccguggguguccuucaaccagaaccuggaguaccagaucggguacaucugcagcggcaucuucggggacaacccccggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggacccgaacggguggaccggcaccgacaacaacuucuccaucaagcaggacaucguggggaucaacgaguggagcggcuacuccgggagcuucguccagcaccccgagcucaccggccuggacugcauccgccccugcuucuggguggagcugauccggggccgccccaaggagaacacgaucuggaccuccgggagcuccaucagcuucugcggcgucaacuccgacaccgugggguggagcuggccggacggcgccgagcuccccuucaccaucgacaaguga

SEQ ID NO: 86731 - RNA, 1410 nt, Artificial Sequence
  derived and/or modified sequence opt1 from neuraminidase__InfluenzaA__AIM55851
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggcggaucgugaaguccguggagaugaacgcccccaacuaccacuacgaggagugcuccugcuaccccgacagcuccgagaucacgugcgucugccgcgacaacuggcacggcagcaaccggccguggguguccuucaaccagaaccucgaguaccagaucggguacaucugcagcggcguguucggggacaacccccgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggacccgaacggguggaccggcaccgacaacaaguucuccaucaagcaggacaucgucgggaucaacgaguggagcggcuacuccgggagcuucgugcagcaccccgagcugacgggccuggacugcauccggcccugcuucugggucgagcucauccgcggccggcccgaggagaacaccaucuggaccuccgggagcuccaucagcuucugcggcgugaaguccgacaccgugggguggagcuggccggacggcgccgagcugcccuucacgaucgacaaguga

SEQ ID NO: 86732 - RNA, 1410 nt, Artificial Sequence
  derived and/or modified sequence opt1 from neuraminidase__InfluenzaA__AIM55862
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuucaagaucgagaaggggaagaucgugaaguccguggagaugaacgcccccaacuaccacuacgaggagugcuccugcuaccccgacagcuccgagaucacgugcgucugccgcgacaacuggcacggcagcaaccggccguggguguccuucaaccagaaccucgaguaccagaucggguacaucugcagcggcguguucggggacaacccccgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggacccgaacggguggaacggcaccgacaacaacuucuccaucaagcaggacaucgucgggaucaaggaguggagcggcuacuccgggagcuucgugcagcaccccgagcugaccggccuggacugcauccggcccugcuucugggucgagcucauccgcggccggcccgaggagaacacgaucuggaccuccgggagcuccaucagcuucugcggcgugaacuccgacaccgugggguggagcuggccggacggcgccgagcugcccuucaccaucgacaaguga

SEQ ID NO: 86733 - RNA, 1410 nt, Artificial Sequence
  derived and/or modified sequence opt1 from neuraminidase__InfluenzaA__AIM55873
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 86734 - RNA, 1410 nt, Artificial Sequence; identical to SEQ ID NO: 86733
  derived and/or modified sequence opt1 from neuraminidase__InfluenzaA__AIM55884

SEQ ID NO: 86735 - RNA, 1410 nt, Artificial Sequence; identical to SEQ ID NO: 86733
  derived and/or modified sequence opt1 from neuraminidase__InfluenzaA__AIM55918

SEQ ID NO: 86736 - RNA, 1410 nt, Artificial Sequence
  derived and/or modified sequence opt1 from neuraminidase__InfluenzaA__AIM55929
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaccggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacacgaucaagagcuggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaacuucagcaucaagcaggacaucgucgggaucaaggagugguccggcuacagcggguccuucgugcagcacccggagcugaccggccuggacugcauccgccccugcuucugggucgagcucauccggggccgccccgaggagaacaccaucuggaccagcggguccagcaucuccuucugcggcgugaacagcgacacgguggggugguccuggcccgacggcgccgagcugccguucaccaucgacaaguga

SEQ ID NO: 86737 - RNA, 1410 nt, Artificial Sequence
  derived and/or modified sequence opt1 from neuraminidase__InfluenzaA__AIM55940
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcuccacgaacuucgccgcgggccagagcguggugccggucaagcuggccgggaacuccagccucugccccguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgaggugcccagccccuacaacagccgguucgaguccgucgccuggagcgcguccgccugccacgacgggaucaacuggcucaccaucggcaucagcggcccggacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggacccgaacggguggaccggcaccgacaacaacuucagcaucaagcaggacaucgucgggaucaaggagugguccggcuacagcggguccuucgugcagcaccccgagcugacgggccuggacugcauccgccccugcuucugggucgagcucauccggggccgccccgaggagaacaccaucuggaccagcggguccagcaucuccuucugcggcgugaacagcgacaccguggggugguccuggccggacggcgccgagcugcccuucacgaucgacaaguga

SEQ ID NO: 86738 - RNA, 1410 nt, Artificial Sequence
  derived and/or modified sequence opt1 from neuraminidase__InfluenzaA__AIM55965
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacgccgugggguggagcuggccggacggcgcggagcugcccuucaccaucgacaaguga

SEQ ID NO: 86739 - RNA, 1410 nt, Artificial Sequence
  derived and/or modified sequence opt1 from neuraminidase__InfluenzaA__AIM55976
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 86740 - RNA, 1410 nt, Artificial Sequence
  derived and/or modified sequence opt1 from neuraminidase__InfluenzaA__AIM55987
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaccggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacacgaucaagagcuggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaacuucagcaucaagcaggacaucgucgggaucaaggagugguccggcuacagcggguccuucgugcagcacccggagcugaccggccuggacugcauccgccccugcuucugggucgagcucauccggggccgccccgaggagaacaccaucuggaccagcggguccagcaucuccuucugcggcgugaacagcgacacgguggacugguccuggcccgacggggccgagcugccguucaccaucgacaaguga

SEQ ID NO: 86741 - RNA, 1410 nt, Artificial Sequence
  derived and/or modified sequence opt1 from neuraminidase__InfluenzaA__AIM55998
augaaccccaaccagaagaucaucaccaucggcagcgugugcaugaccaucgggauggccaaccugauccuccagaucggcaacacgaucuccaucugggucagccacuccauccagcuggggaaccagagccagaucgagaccugcaaccaguccgugaucaccuacgagaacaacaccugggugaaccagacguacgucaacaucagcaacaccaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggacgaucaaggaccgguccccguaccgcacccugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacacgaucaaguccuggcgcaacaacauccugcggacccaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcacggacaacaaguucuccaucaagcaggacaucgucgggaucaacgaguggagcggcuacuccgggagcuucgugcagcaccccgagcugaccggccuggacugcauccgccccugcuucugggucgagcucauccggggccgccccgaggagaacaccaucuggaccuccgggagcuccaucagcuucugcggcgugaaguccgacacggugggguggagcuggccggacggcgccgagcugcccuucaccaucgacaaguga

SEQ ID NO: 86742 - RNA, 1410 nt, Artificial Sequence; identical to SEQ ID NO: 86739
  derived and/or modified sequence opt1 from neuraminidase__InfluenzaA__AIM56009

SEQ ID NO: 86743 - RNA, 1410 nt, Artificial Sequence; identical to SEQ ID NO: 86739
  derived and/or modified sequence opt1 from neuraminidase__InfluenzaA__AIM56020

SEQ ID NO: 86744 - RNA, 1410 nt, Artificial Sequence; identical to SEQ ID NO: 86739
  derived and/or modified sequence opt1 from neuraminidase__InfluenzaA__AIM56031

SEQ ID NO: 86745 - RNA, 1410 nt, Artificial Sequence
  derived and/or modified sequence opt1 from neuraminidase__InfluenzaA__AIM56042
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcaacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 86746 - RNA, 1410 nt, Artificial Sequence
  derived and/or modified sequence opt1 from neuraminidase__InfluenzaA__AIM56053
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacgagcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggguguucggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagaugaucugggaccccaacggcuggaccgggaccgacaacaacuucagcaucaagcaggacaucgucggcaucaaggagugguccggguacagcggcuccuucgugcagcacccggagcugacggggcuggacugcauccgccccugcuucugggucgagcucauccggggccgccccgaggagaacaccaucuggaccagcggcuccagcaucuccuucugcggggugaacagcgacaccgugggcugguccuggcccgacggggccgagcugccguucacgaucgacaaguga

SEQ ID NO: 86747 - RNA, 1410 nt, Artificial Sequence
  derived and/or modified sequence opt1 from neuraminidase__InfluenzaA__AIM56064
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucgugcggggccgccccgaggagaacaccaucuggaccuccgggagcuccaucagcuucugcggcgugaacuccgacaccgucggguggagcuggccggacggcgccgagcugcccuucacgaucgacaaguga

SEQ ID NO: 86748 - RNA, 1410 nt, Artificial Sequence
  derived and/or modified sequence opt1 from neuraminidase__InfluenzaA__AIM56086
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucagcagccggaagggcuucgagaugaucugggacccgaacggguggaccggcacggacaacaacuucuccaucaagcaggacaucaucgggaucaaggaguggagcggcuacuccgggagcuucguccagcaccccgagcugaccggccuggacugcauccgccccugcuucuggguggagcucauccggggccgccccgaggagaacaccaucuggaccuccgggagcuccaucagcuucugcggcgucaacuccgacacggugggguggagcuggccggacggcgccgagcugcccuucaccaucgacaaguga

SEQ ID NO: 86749 - RNA, 1410 nt, Artificial Sequence
  derived and/or modified sequence opt1 from neuraminidase__InfluenzaA__AIM56097
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugagcgucaagcuggccggcaacuccagccucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccgucgccuggagcgcguccgccugccacgacggcaucaacuggcucaccaucgggaucagcggccccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggguguucggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagaugaucugggaccccaacggcuggaccgggaccgacaacaacuucagcaucaagcaggacaucgucggcaucaaggagugguccggguacagcggcuccuucgugcagcacccggagcugacggggcuggacugcauccgccccugcuucugggucgagcucauccggggccgccccgaggagaacaccaucuggaccagcggcuccagcaucuccuucugcggggugaacagcgacaccgugggcugguccuggcccgacggggccgagcugccguucacgaucgacaaguga

SEQ ID NO: 86750 - RNA, 1410 nt, Artificial Sequence
  derived and/or modified sequence opt1 from neuraminidase__InfluenzaA__AIM56108
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccuggaucaaccagaccuacgugaacaucagcaacacgaacuucgccgcgggccaguccgucgugccggugaagcuggccgggaacagcucccucugccccgucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcguggccugguccgcgagcgccugccacgacgggaucaacuggcucaccaucggcaucuccggcccggacagcggggccgucgccgugcugaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcguguucggggacaacccccggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggacccgaacggguggaccggcaccgacaacaacuucuccaucaagcaggacaucguggggaucaaggaguggagcggcuacuccgggagcuucguccagcaccccgagcugacgggccuggacugcauccgccccugcuucuggguggagcucauccggggccgccccgaggagaacaccaucuggaccuccgggagcuccaucagcuucugcggcgucaacuccgacaccgugggguggagcuggccggacggcgccgagcugcccuucacgaucgacaaguga

SEQ ID NO: 86751 - RNA, 1410 nt, Artificial Sequence
  derived and/or modified sequence opt1 from neuraminidase__InfluenzaA__AIM56119
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 86752 - RNA, 1410 nt, Artificial Sequence
  derived and/or modified sequence opt1 from neuraminidase__InfluenzaA__AIM56130
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaaguucuccaucaagcaggacaucgucgggaucaacgaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaaguccgacaccgugggguggagcuggccggacggcgccgagcugcccuucacgaucgacaaguga

SEQ ID NO: 86753 - RNA, 1410 nt, Artificial Sequence
  derived and/or modified sequence opt1 from neuraminidase__InfluenzaA__AIM56141
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaucuacgagaacaacaccugggugaaccagaccuacgucaacaucagcaacaccaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccgucgccuggagcgcguccgccugccacgacgggaucaacuggcucacgaucggcaucagcggccccgacuccggggccguggccgugcugaaguacaacggcaucaucaccgacaccaucaagagcuggcgcaacaacauccugcggacccaggaguccgagugcgcgugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaaggagugguccggcuacagcggguccuucgugcagcacccggagcugaccggccuggacugcauccgccccugcuucugggucgagcucauccggggccgccccgaggagaacacgaucuggaccagcggguccagcaucuccuucugcggcgugaacagcgacaccguggggugguccuggcccgacggcgccgagcugccguucaccaucgacaaguga

SEQ ID NO: 86754 - RNA, 1410 nt, Artificial Sequence; identical to SEQ ID NO: 86739
  derived and/or modified sequence opt1 from neuraminidase__InfluenzaA__AIM56152

SEQ ID NO: 86755 - RNA, 1410 nt, Artificial Sequence
  derived and/or modified sequence opt1 from neuraminidase__InfluenzaA__AIM56163
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucagcagccggaagggcuucgagaugaucugggacccgaacggguggaccggcacggacaacaacuucuccaucaagcaggacaucgucgggaucaaggaguggagcggcuacuccgggagcuucgugcagcaccccgagcugaccggccuggacugcauccgccccugcuucugggucgagcucauccggggccgccccgaggagaacaccaucuggaccuccgggagcuccaucagcuucugcggcgugaacuccgacacggugggguggagcuggccggacggcgccgagcugcccuucaccaucgacaaguga

SEQ ID NO: 86756 - RNA, 1410 nt, Artificial Sequence
  derived and/or modified sequence opt1 from neuraminidase__InfluenzaA__AIM56174
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacggucgacaaguga

SEQ ID NO: 86757 - RNA, 1410 nt, Artificial Sequence; identical to SEQ ID NO: 86752
  derived and/or modified sequence opt1 from neuraminidase__InfluenzaA__AIM56185

SEQ ID NO: 86758 - RNA, 1410 nt, Artificial Sequence; identical to SEQ ID NO: 86751
  derived and/or modified sequence opt1 from neuraminidase__InfluenzaA__AIM56196

SEQ ID NO: 86759 - RNA, 1410 nt, Artificial Sequence; identical to SEQ ID NO: 86733
  derived and/or modified sequence opt1 from neuraminidase__InfluenzaA__AIM56207

SEQ ID NO: 86760 - RNA, 1410 nt, Artificial Sequence
  derived and/or modified sequence opt1 from neuraminidase__InfluenzaA__AIM56229
augaaccccaaccagaagaucaucaccaucggcagcgugugcaugaccaucgggauggccaaccugauccuccagaucggcaacacgaucuccaucugggucagccacuccauccagaucgggaaccagagccagaucgagaccugcaaccaguccgugaucaccuacgagaacaacaccugggugaaccagacguacgucaacaucagcaacaccaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggacgaucaaggaccggagccccuaccgcacccugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacacgaucaagagcuggcgcaacaacauccugcggacccaggaguccgagugcgcgugcgucaacgggagcugcuucaccaucaugaccgacggcccguccgacggccacgccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaaguucagcaucaagcaggacaucgucgggaucaacgagugguccggcuacagcggguccuucgugcagcacccggagcucaccggccuggacugcauccgccccugcuucugggucgagcugauccggggccgccccgaggagaacaccaucuggaccagcggguccagcaucuccuucugcggcgugaacagcgacacgguggggugguccuggcccgacggcgccgagcucccguucaccaucgacaaguga

SEQ ID NO: 86761 - RNA, 1410 nt, Artificial Sequence
  derived and/or modified sequence opt1 from neuraminidase__InfluenzaA__AIM56240
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacagcucccugugcagcguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacgacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 86762 - RNA, 1410 nt, Artificial Sequence
  derived and/or modified sequence opt1 from neuraminidase__InfluenzaA__AIM56251
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 86763 - RNA, 1410 nt, Artificial Sequence; identical to SEQ ID NO: 86762
  derived and/or modified sequence opt1 from neuraminidase__InfluenzaA__AIM56262

SEQ ID NO: 86764 - RNA, 1410 nt, Artificial Sequence; identical to SEQ ID NO: 86733
  derived and/or modified sequence opt1 from neuraminidase__InfluenzaA__AIM56273

SEQ ID NO: 86765 - RNA, 1410 nt, Artificial Sequence
  derived and/or modified sequence opt1 from neuraminidase__InfluenzaA__AIM56284
augaaccccaaccagaagaucaucaccaucggcagcgugugcaucaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacgucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 86766 - RNA, 1410 nt, Artificial Sequence; identical to SEQ ID NO: 86733
  derived and/or modified sequence opt1 from neuraminidase__InfluenzaA__AIM56295

SEQ ID NO: 86767 - RNA, 1410 nt, Artificial Sequence; identical to SEQ ID NO: 86733
  derived and/or modified sequence opt1 from neuraminidase__InfluenzaA__AIM56306

SEQ ID NO: 86768 - RNA, 1410 nt, Artificial Sequence; identical to SEQ ID NO: 86733
  derived and/or modified sequence opt1 from neuraminidase__InfluenzaA__AIM56317

SEQ ID NO: 86769 - RNA, 1410 nt, Artificial Sequence; identical to SEQ ID NO: 86752
  derived and/or modified sequence opt1 from neuraminidase__InfluenzaA__AIM56339

SEQ ID NO: 86770 - RNA, 1410 nt, Artificial Sequence
  derived and/or modified sequence opt1 from neuraminidase__InfluenzaA__AIM56350
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcaucaacuccgacaccgugggguggagcuggccggacggcgccgagcugcccuucacgaucgacaaguga

SEQ ID NO: 86771 - RNA, 1410 nt, Artificial Sequence; identical to SEQ ID NO: 86762
  derived and/or modified sequence opt1 from neuraminidase__InfluenzaA__AIM56361

SEQ ID NO: 86772 - RNA, 1410 nt, Artificial Sequence; identical to SEQ ID NO: 86733
  derived and/or modified sequence opt1 from neuraminidase__InfluenzaA__AIM56372

SEQ ID NO: 86773 - RNA, 1410 nt, Artificial Sequence; identical to SEQ ID NO: 86762
  derived and/or modified sequence opt1 from neuraminidase__InfluenzaA__AIM56383

SEQ ID NO: 86774 - RNA, 1410 nt, Artificial Sequence
  derived and/or modified sequence opt1 from neuraminidase__InfluenzaA__AIM56394
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgucaacagcgacaccguggggugguccuggcccgacggcgccgagcucccguucacgaucgacaaguga

SEQ ID NO: 86775 - RNA, 1410 nt, Artificial Sequence; identical to SEQ ID NO: 86751
  derived and/or modified sequence opt1 from neuraminidase__InfluenzaA__AIM56405

SEQ ID NO: 86776 - RNA, 1410 nt, Artificial Sequence
  derived and/or modified sequence opt1 from neuraminidase__InfluenzaA__AIM56416
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacaucaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcacguucuuccugacccagggcgcccuccugaacgacaagcacuccaacgggaccaucaaggaccgguccccguaccgcacccugaugagcugccccaucggcgaggugcccucccccuacaacagccgguucgagagcgucgccugguccgcgagcgccugccacgacgggaucaacuggcucacgaucggcaucuccggcccggacaacggggccguggccgugcugaaguacaacggcaucaucaccgacaccaucaagagcuggcgcaacaacauccugcggacccaggaguccgagugcgcgugcgucaacgggagcugcuucacgaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucagcagccggaagggcuucgagaugaucugggacccgaacggguggaccggcaccgacaacaacuucuccaucaagcaggacaucgucgggaucaaggaguggagcggcuacuccgggagcuucgugcagcaccccgagcugacgggccuggacugcauccgccccugcuucugggucgagcucauccggggccgccccgaggagaacaccaucuggaccuccgggagcuccaucagcuucugcggcgugaacuccgacaccgugggguggagcuggccggacggcgccgagcugcccuucacgaucgacaaguga

SEQ ID NO: 86777 - RNA, 1410 nt, Artificial Sequence; identical to SEQ ID NO: 86751
  derived and/or modified sequence opt1 from neuraminidase__InfluenzaA__AIM56428

SEQ ID NO: 86778 - RNA, 1410 nt, Artificial Sequence; identical to SEQ ID NO: 86733
  derived and/or modified sequence opt1 from neuraminidase__InfluenzaA__AIM56439

SEQ ID NO: 86779 - RNA, 1410 nt, Artificial Sequence
  derived and/or modified sequence opt1 from neuraminidase__InfluenzaA__AIM56450
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacagcucccugugccccgugagcggcugggccaucuacuccaaggacaacagcgugcgcgucggcuccaagggggacguguucgugauccgggagcccuucaucagcugcagcccccucgagugccgcaccuucuuccugacccagggcgcccugcucaacgacaagcacagcaacgggaccaucaaggaccgguccccguaccgcacgcugaugagcugccccaucggcgagguccccucccccuacaacagccgguucgagagcguggccugguccgcgagcgccugccacgacgggaucaacuggcugaccaucggcaucuccggcccggacagcggggccguggccguccucaaguacaacggcaucaucaccgacaccaucaaguccuggcgcaacgacauccugcggacgcaggagagcgagugcgcgugcgugaacggguccugcuucaccaucaugaccgacggccccagcgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgcccguggguguccuucaaccagaaccuggaguacaagaucggguacaucugcagcggcaucuucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccgucaagcaggacaucguggggaucaacgaguggagcggcuacuccgggagcuucguccagcaccccgagcucacgggccuggacugcauccgccccugcuucuggguggagcugauccggggccgccccaaggagaacaccaucuggaccuccgggagcuccaucagcuucugcggcgugaacuccgacaccgucggguggagcuggccggacggcgccgagcuccccuucacgaucgacaaguga

SEQ ID NO: 86780 - RNA, 1410 nt, Artificial Sequence
  derived and/or modified sequence opt1 from neuraminidase__InfluenzaA__AIM56461
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggaagaacaacauccugcgcacgcaggaguccgagugcgcgugcgucaacgggagcugcuucaccaucaugaccgacggcccguccgacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccuggaguaccagaucggguacaucugcuccggcguguucggggacaacccgcgccccaacgacaagaccggcagcugcggccccgucuccagcaacggggccaacggcgugaagggguucagcuucaaguacggcaacgggguguggaucggccggaccaaguccaucagcucccgcaagggcuucgagaugaucugggaccccaacggguggaccggcaccgacaacaaguucagcaucaagcaggacaucgucggggugaacgagugguccggcuacagcggguccuucguccagcacccggagcucacgggccuggacugcauccggcccugcuucuggguggagcugauccgcggccggcccgaggagaacaccaucuggaccagcggguccagcaucuccuucugcggcgugaacagcgacaccgucgggugguccuggcccgacggcgccgagcucccguucacgaucgacaaguga

SEQ ID NO: 86781 - RNA, 1410 nt, Artificial Sequence
  derived and/or modified sequence opt1 from neuraminidase__InfluenzaA__AIM56472
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugcaacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 86782 - RNA, 1410 nt, Artificial Sequence; identical to SEQ ID NO: 86739
  derived and/or modified sequence opt1 from neuraminidase__InfluenzaA__AIM56483

SEQ ID NO: 86783 - RNA, 1410 nt, Artificial Sequence; identical to SEQ ID NO: 86762
  derived and/or modified sequence opt1 from neuraminidase__InfluenzaA__AIM56494

SEQ ID NO: 86784 - RNA, 1410 nt, Artificial Sequence; identical to SEQ ID NO: 86752
  derived and/or modified sequence opt1 from neuraminidase__InfluenzaA__AIM56505

SEQ ID NO: 86785 - RNA, 1410 nt, Artificial Sequence; identical to SEQ ID NO: 86751
  derived and/or modified sequence opt1 from neuraminidase__InfluenzaA__AIM56516

SEQ ID NO: 86786 - RNA, 1410 nt, Artificial Sequence
  derived and/or modified sequence opt1 from neuraminidase__InfluenzaA__AIM56527
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugagcgucaagcuggccggcaacuccagccucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccgucgccuggagcgcguccgccugccacgacggcaucaacuggcucaccaucgggaucagcggccccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccggggugcugggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagauggucugggaccccaacggcuggaccgggaccgacaacaacuucagcaucaagcaggacaucgugggcaucaaggagugguccggguacagcggcuccuucguccagcacccggagcugacggggcucgacugcauccgccccugcuucuggguggagcugauccggggccgccccgaggagaacaccaucuggaccagcggcuccagcaucuccuucugcggggugaacagcgacaccgucggcugguccuggcccgacggggccgagcugccguucacgaucgacaaguga

SEQ ID NO: 86787 - RNA, 1410 nt, Artificial Sequence; identical to SEQ ID NO: 86733
  derived and/or modified sequence opt1 from neuraminidase__InfluenzaA__AIM56538

SEQ ID NO: 86788 - RNA, 1410 nt, Artificial Sequence
  derived and/or modified sequence opt1 from neuraminidase__InfluenzaA__AIM56549
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgaggugaccugcgucugccgggacaacuggcacggcuccaaccgccccugggugagcuucaaccagaaccuggaguaccagaucggguacaucugcuccggcgucuucggggacaacccgcggcccaacgacaagacgggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 86789 - RNA, 1410 nt, Artificial Sequence
  derived and/or modified sequence opt1 from neuraminidase__InfluenzaA__AIM56560
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccauccacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcguguucggggacaacccccggcccaacgacaagaccggcagcugcggccccgucaccuccaacggggccaacggcgugaagggguucagcuucaaguacggcaacgggguguggaucggccgcaccaaguccaucagcagccggaagggcuucgagaugaucugggacccgaacggguggaccggcacggacaacaacuucuccaucaagcaggacaucgucgggaucaaggaguggagcggcuacuccgggagcuucgugcagcaccccgagcugaccggccuggacugcauccgccccugcuucugggucgagcucauccggggccgccccgaggagaacaccaucuggaccuccgggagcuccaucagcuucugcggcgugaacuccgacacggugggguggagcuggccggacggcgccgagcugcccuucaccaucgacaaguga

SEQ ID NO: 86790 - RNA, 1410 nt, Artificial Sequence; identical to SEQ ID NO: 86739
  derived and/or modified sequence opt1 from neuraminidase__InfluenzaA__AIM56571

SEQ ID NO: 86791 - RNA, 1410 nt, Artificial Sequence
  derived and/or modified sequence opt1 from neuraminidase__InfluenzaA__AIM56582
augaaccccaaccagaagaucaucaccaucggcagcgugugcaucaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 86792 - RNA, 1410 nt, Artificial Sequence
  derived and/or modified sequence opt1 from neuraminidase__InfluenzaA__AIM56593
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcggagcaguccguggugagcgucaagcuggccggcaacuccagccucugcccgguguccgggugggccaucuacagcaaggacaacuccgugcgcaucggcagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccgucgccuggagcgcguccgccugccacgacggcaucaacuggcucaccaucgggaucagcggccccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacgggccguccgacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccggggugcugggcgacaacccgcggcccaacgacaagaccgggagcugcggccccgucuccagcaacggcgccaacggggugaagggcuucagcuucaaguacgggaacggcguguggaucgggcgcaccaaguccaucagcucccggaagggcuucgagaugaucugggaccccaacggcuggaccgagaccgacaacaacuucagcaucaagcaggacaucgucgggaucaaggagugguccggcuacagcggguccuucgugcagcacccggagcugacgggccucgacugcauccgccccugcuucugggucgagcugauccgggggcgccccgaggagaacaccaucuggaccagcggcuccagcaucuccuucugcggcgugaacagcgacaccguggggugguccuggcccgacggcgccgagcugccguucacgaucgacaaguga

SEQ ID NO: 86793 - RNA, 1410 nt, Artificial Sequence
  derived and/or modified sequence opt1 from neuraminidase__InfluenzaA__AIM56604
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacaucaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcacguucuuccugacccagggcgcccugcucaacgacaagcacuccaacgggaccaucaaggaccggagccccuaccgcacccugauguccugcccgaucggcgaggugcccagccccuacaacagccgguucgaguccgucgccuggagcgcguccgccugccacgacgggaucaacuggcugacgaucggcaucagcggccccgacuccggggccguggccgugcucaaguacaacggcaucaucaccgacaccaucaagagcuggcgcaacaacauccugcggacccaggaguccgagugcgcgugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcucaccggccuggacugcauccgccccugcuucugggucgagcugauccggggccgccccgaggagaacacgaucuggaccagcggguccagcaucuccuucugcggcgugaacagcgacaccguggggugguccuggcccgacggcgccgagcucccguucaccaucgacaaguga

SEQ ID NO: 86794 - RNA, 1410 nt, Artificial Sequence
  derived and/or modified sequence opt1 from neuraminidase__InfluenzaA__AIM56615
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucgacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacuccaacggcguguggaucgggcgcaccaagagcaucuccagccggaagggcuucgagaugaucugggaccccaacggcuggaccgggaccgacaacaaguucuccaucaagcaggacaucgucggcaucaacgaguggagcggguacuccggcagcuucgugcagcacccggagcucacggggcuggacugcauccgccccugcuucugggucgagcugauccggggccgccccgaggagaacaccaucuggaccuccggcagcuccaucagcuucugcggggugaacuccgacaccgugggcuggagcuggcccgacggggccgagcucccguucacgaucgacaaguga

SEQ ID NO: 86795 - RNA, 1410 nt, Artificial Sequence; identical to SEQ ID NO: 86788
  derived and/or modified sequence opt1 from neuraminidase__InfluenzaA__AIM56626

SEQ ID NO: 86796 - RNA, 1410 nt, Artificial Sequence; identical to SEQ ID NO: 86733
  derived and/or modified sequence opt1 from neuraminidase__InfluenzaA__AIM56637

SEQ ID NO: 86797 - RNA, 1410 nt, Artificial Sequence; identical to SEQ ID NO: 86739
  derived and/or modified sequence opt1 from neuraminidase__InfluenzaA__AIM56648

SEQ ID NO: 86798 - RNA, 1410 nt, Artificial Sequence
  derived and/or modified sequence opt1 from neuraminidase__InfluenzaA__AIM56659
augaaccccaaccagaagaucaucaccaucggcagcgugugcaugaccaucgggauggccaaccugauccuccagaucggcaacaucaucuccaucugggucagccacuccauccagcuggggaaccagagccacaucgagacgugcaaccaguccgugaucaccuacgagaacaacaccugggugaaccagaccuacgucaacaucagcaacacgaacuucgccgcgggccaguccguggugccggucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacagcaacgggaccaucaaggaccgguccccguaccgcacgcugaugagcugccccaucggcgaggugcccucccccuacaacagccgguucgagagcgucgccugguccgcgagcgccugccacgacgggaucaacuggcucaccaucggcaucuccggcccggacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaucggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaaggaguggagcggcuacuccgggagcuucgugcagcaccccgagcugaccggccuggacugcauccgccccugcuucugggucgagcucauccggggccgccccgaggagaagacgaucuggaccuccgggagcuccaucagcuucugcggcgugaacuccgacaccgugggguggagcuggccggacggcgccgagcugcccuucaccaucgacaaguga

SEQ ID NO: 86799 - RNA, 1410 nt, Artificial Sequence
  derived and/or modified sequence opt1 from neuraminidase__InfluenzaA__AIM56670
augaaccccaaccagaagaucaucaccaucggcagcgugugcaugaccaucgggauggccaaccugauccuccagaucggcaacacgaucuccaucugggucagccacuccauccagaucgggaaccagagccagaucgagaccugcaaccaguccgugaucaccuacgagaacaacaccugggugaaccagacguacgucaacaucagcaacaccaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggacgaucaaggaccggagccccuaccgcacccugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacacgaucaagagcuggcgcaacaacauccugcggacccaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaaguucagcaucaagcaggacaucgucgggaucaacgagugguccggcuacagcggguccuucgugcagcacccggagcucaccggccuggacugcauccgccccugcuucugggucgagcugauccggggccgccccgaggagaacaccaucuggaccagcggguccagcaucuccuucugcggcgugaacagcgacacgguggggugguccuggcccgacggcgccgagcucccguucaccaucgacaaguga

SEQ ID NO: 86800 - RNA, 1410 nt, Artificial Sequence; identical to SEQ ID NO: 86751
  derived and/or modified sequence opt1 from neuraminidase__InfluenzaA__AIM56703

SEQ ID NO: 86801 - RNA, 1410 nt, Artificial Sequence
  derived and/or modified sequence opt1 from neuraminidase__InfluenzaA__AIM56714
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccguccccuccaacggggccaacggcgugaagggguucagcuucaaguacggcaacgggguguggaucggccgcaccaagagcaucuccagccggaagggcuucgagaugaucugggacccgaacggguggaccggcaccgacaacaaguucuccaucaagcaggacaucgucgggaucaacgaguggagcggcuacuccgggagcuucgugcagcaccccgagcucacgggccuggacugcauccgccccugcuucugggucgagcugauccggggccgccccgaggagaacaccaucuggaccuccgggagcuccaucagcuucugcggcgugaacuccgacaccgugggguggagcuggccggacggcgccgagcuccccuucacgaucgacaaguga

SEQ ID NO: 86802 - RNA, 1410 nt, Artificial Sequence
  derived and/or modified sequence opt1 from neuraminidase__InfluenzaA__AIM56725
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgaggugaccugcgucugccgggacaacuggcacggcuccaaccgccccugggugagcuucaaccagaaccuggaguaccagaucggguacaucugcuccggcaucuucggggacaacccgcggcccaacgacaagacgggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccguggggugguccuggcccgacggcgccgagcucccguucacgaucgacaaguga

SEQ ID NO: 86803 - RNA, 1410 nt, Artificial Sequence; identical to SEQ ID NO: 86751
  derived and/or modified sequence opt1 from neuraminidase__InfluenzaA__AIM56736

SEQ ID NO: 86804 - RNA, 1410 nt, Artificial Sequence
  derived and/or modified sequence opt1 from neuraminidase__InfluenzaA__AIM56747
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcucccucgagugccgcaccuucuuccugacccagggcgcccugcucaacgacaagcacagcaacgggaccaucaaggaccggucccccuaccgcacgcugaugagcugccccaucggcgaggugccgagccccuacaacucccgguucgagagcgucgccugguccgcgagcgccugccacgacgggaucaacuggcugaccaucggcaucuccggccccgacagcggggccguggccgugcucaaguacaacggcaucaucaccgacaccaucaaguccuggcgcaacaacauccugcggacgcaggagagcgagugcgcgugcgucaacggguccugcuucaccaucaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcguguucggggacaacccccggccgaacgacaagaccggcuccugcggccccgucagcagcaacggggccaacggcgugaagggguucuccuucaaguacggcaacgggguguggaucggccgcaccaagagcaucuccagccggaagggcuucgagaugaucugggaccccaacggguggaccggcaccgacaacaaguucuccaucaagcaggacaucgucgggaucaacgaguggagcggcuacuccgggagcuucgugcagcaccccgagcucacgggccuggacugcauccgcccgugcuucugggucgagcugauccggggccgccccgaggagaacaccaucuggaccuccgggagcuccaucagcuucugcggcgugaacuccgacaccgugggguggagcuggcccgacggcgccgagcuccccuucacgaucgacaaguga

SEQ ID NO: 86805 - RNA, 1410 nt, Artificial Sequence; identical to SEQ ID NO: 86788
  derived and/or modified sequence opt1 from neuraminidase__InfluenzaA__AIM56758

SEQ ID NO: 86806 - RNA, 1410 nt, Artificial Sequence; identical to SEQ ID NO: 86751
  derived and/or modified sequence opt1 from neuraminidase__InfluenzaA__AIM56769

SEQ ID NO: 86807 - RNA, 1410 nt, Artificial Sequence
  derived and/or modified sequence opt1 from neuraminidase__InfluenzaA__AIM56780
augaaccccaaccagaagaucaucaccaucggcagcgugugcaugaccaucgggauggccaaccugauccuccagaucggcaacaucaucuccaucugggucagccacuccauccagcuggggaaccagagccagaucggcacgugcaaccaguccgugaucaccuacgagaacaacaccugggugaaccagaccuacgucaacaucagcaacacgaacuucgccgcggggcaguccguggugagcgucaagcuggccggcaacuccagccucugcccgguguccggcugggccaucuacagcaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacagccgguucgaguccgucgccuggagcgcguccgccugccacgacggcaucaacuggcucaccaucggcaucagcgggcccgacuccggcgccguggccgugcugaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucaucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggguguucggcgacaacccgcggcccaacgacaagaccggcagcugcgggcccguguccagcaacggcgccaacggggucaagggcuucagcuucaaguacgggaacggcguguggaucggccgcaccaaguccaucagcucccggaagggguucgagaugaucugggaccccaacggcuggaccgggaccgacaacaaguucagcaucaagcaggacaucgugggcauccacgagugguccggguacagcggcuccuucguccagcacccggagcugacgggccuggacugcauccgccccugcuucuggguggagcucauccgggggcgccccgaggagaacaccaucuggaccagcggcuccagcaucuccuucugcggggucaacagcgacaccgugggcugguccuggcccgacggcgccgagcugccguucacgaucgacaaguga

SEQ ID NO: 86808 - RNA, 1410 nt, Artificial Sequence
  derived and/or modified sequence opt1 from neuraminidase__InfluenzaA__AIM56791
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucagcuggcucaccaucggcaucuccggccccgacagcggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcguguucggggacaacccgcggcccaacgacaagaccggcuccugcggccccgucagcagcaacggggccaacggcgugaagggguucuccuucaaguacggcaacgggguguggaucggccgcaccaagagcaucuccagccggaagggcuucgagaugaucugggaccccaacggguggaccggcaccgacaacaacuucuccaucaagcaggacaucgucgggaucaaggaguggagcggcuacuccgggagcuucgugcagcacccggagcugacgggccuggacugcauccgccccugcuucugggucgagcucauccggggccgccccgaggagaacaccaucuggaccuccgggagcuccaucagcuucugcggcgugaacuccgacaccgugggguggagcuggcccgacggcgccgagcugccguucacgaucgacaaguga

SEQ ID NO: 86809 - RNA, 1410 nt, Artificial Sequence
  derived and/or modified sequence opt1 from neuraminidase__InfluenzaA__AIM56813
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagcaaguucgaguccgucgccuggagcgcguccgccugccacgacgggaucaacuggcugaccaucggcaucagcggccccgacaacggggccguggccgugcucaaguacaacggcaucaucaccgacaccaucaaguccuggcggaacaacauccugcgcacgcaggagagcgagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccuggaguaccagaucggguacaucugcagcggcguguucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaaguucuccaucaagcaggacaucgucgggaucaacgaguggagcggcuacuccgggagcuucgugcagcacccggagcucacgggccuggacugcauccggcccugcuucugggucgagcugauccgcggccggcccgaggagaacaccaucuggaccuccgggagcuccaucagcuucugcggcgugaacuccgacaccgugggguggagcuggcccgacggcgccgagcucccguucacgaucgacaaguga

SEQ ID NO: 86810 - RNA, 1410 nt, Artificial Sequence
  derived and/or modified sequence opt1 from neuraminidase__InfluenzaA__AIM56824
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccguccccuccaacggggccaacggcgugaagggguucagcuucaaguacagcaacggcguguggaucgggcgcaccaaguccaucagcucccggaagggcuucgagaugaucugggacccgaacggcuggaccgggaccgacaacaaguucagcaucaagcaggacaucgucggcaucaacgagugguccggguacagcggcuccuucgugcagcaccccgagcucacggggcuggacugcauccgccccugcuucugggucgagcugauccggggccgccccgaggagaacaccaucuggaccagcggcuccagcaucuccuucugcggggugaacagcgacaccgugggcugguccuggccggacggggccgagcuccccuucacgaucgacaaguga

SEQ ID NO: 86811 - RNA, 1398 nt, Artificial Sequence
  derived and/or modified sequence opt1 from neuraminidase__InfluenzaA__AIN76385
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgggacgaccaacaccucccagaccaucaucaacaacuacuacaacgagacgaacaucaccaacauccagauggaggagcgcaccagccggaacuucaacucccugaccaagggccucugcacgaucaacagcuggcacaucuacggcaaggacaacgccguccgcaucggggaguccagcgacgugcuggugacccgggagcccuacgucuccugcgaccccgacgagugccgcuucuacgcccugagccagggcaccaccauccgggggaagcacuccaacggcacgauccacgaccgcagccaguaccgggcgcucaucuccuggccgcugagcuccccgcccaccguguacaacagccgcguggagugcaucgggugguccagcaccuccugccacgacggcaagagccggaugagcaucugcaucuccggccccaacaacaacgccagcgccgucgugugguacaaccgccggcccguggccgagaucaacaccugggcgcgcaacauccugcggacgcaggaguccgagugcgucugccacaacgggaucugccccaucguguucaccgacggcagcgccaccgggcccgccgacacccgcaucuacuacuucaaggagggcaagauccucaagugggagucccugacgggcaccgccaagcacaucgaggagugcagcugcuacggggagcggaccggcaucacgugcacgugcaaggacaacuggcagggguccaaccgccccgugauccagaucgacccggucgccaugacccacaccagccaguacaucugcucccccgugcugaccgacacgccccggcccaacgacccgaacaucggcaagugcaacgaccccuaccccgggaacaacaacaacggcgugaagggcuucagcuaccucgacggggcgaacaccuggcugggccgcaccaucuccaccgccagccgguccggguacgagaugcugaagguccccaacgcccucaccgacgaccgcagcaagccgauccagggccagaccaucgugcugaacgccgacugguccggguacagcggcuccuucauggacuacugggccgagggcgacugcuaccgggcgugcuucuacguggagcugauccgcgggcgccccaaggaggacaaggucugguggaccagcaacuccaucgugagcaugugcagcuccaccgaguuccucggccaguggaacuggcccgacggggcccggaucgaguacuuccuguga

SEQ ID NO: 86812 - RNA, 1410 nt, Artificial Sequence; identical to SEQ ID NO: 75095
  derived and/or modified sequence opt1 from neuraminidase__InfluenzaA__AIP93105

SEQ ID NO: 86813 - RNA, 1410 nt, Artificial Sequence
  derived and/or modified sequence opt1 from neuraminidase__InfluenzaA__AIP93117
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggaccugcggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcucauccgcggccgcccccaggagacccgggugugguggaccuccaacagcaucguggucuucugcgggaccuccggcacguacgggaccggcagcuggcccgacggggccaacaucaacuucaugccgaucuga

SEQ ID NO: 86814 - RNA, 1410 nt, Artificial Sequence
  derived and/or modified sequence opt1 from neuraminidase__InfluenzaA__AIR93973
augaaccccaaccagaagaucaucaccaucggcagcgugugcaugaccaucgggauggccaaccugauccuccagaucggcaacaucaucuccaucuggaucagccacuccauccagcuggggagccgcaaccagaucgaggccugcaaccaguccgucaucacguacgagaacaacaccugggugaaccagaccuacgugaacaucagcaacaccaacuucgcggccggccaguccgucgugccggugaagcuggccgggaacagcucccucugccccgucagcggcugggccaucuacuccaaggacaacagcauccggaucggcuccaagggggacguguucgugauccgcgagcccuucaucagcugcagcccccuggagugccggacguucuuccugacccagggcgcccuccugaacgacaagcacuccaacgggaccaucaaggaccgcuccccguaccggacccugaugagcugccccaucggcgagguccccucccccuacaacagccgcuucgagagcguggcgugguccgccagcgccugccacgacgggaucaacuggcucacgaucggcaucuccggcccggacaacggggccguggcgguccugaaguacaacggcaucaucaccgacaccaucaagagcuggcggaacaacauccugcgcacccaggaguccgagugcgugugcgugaacgggagcugcuucacggucaugaccgacggccccuccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggccgugggugagcuucaaccagaaccucgaguaccagaucggguacaucugcuccggcaucuucggggacaacccccgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggacccgaacggguggaccgagaccgacaacaacuucagcaucaagcaggacaucgugggcaucaacgagugguccggguacagcggcuccuucguccagcaccccgagcugaccgggcuggacugcauccggcccugcuucuggguggagcucauccgcggccggcccaaggagaacacgaucuggaccagcggcuccagcaucuccuucugcggggucaacagcaacaccgugggcugguccuggccggacggggccgagcugcccuucaccaucgacaaguga

SEQ ID NO: 86815 - RNA, 1410 nt, Artificial Sequence
  derived and/or modified sequence opt1 from neuraminidase__InfluenzaA__AIR93984
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugggcugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 86816 - RNA, 1410 nt, Artificial Sequence
  derived and/or modified sequence opt1 from neuraminidase__InfluenzaA__AIR93995
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucgugccggugaagcuggccgggaacuccagccucugccccgucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagcccguaccgcacccugauguccugccccaucggcgagguccccagccccuacaacucccgguucgagagcguggccuggagcgcguccgccugccacgacgggaucaacuggcucacgaucggcaucagcggcccggacaacggggccguggccguccugaaguacaacggcaucaucaccgacaccaucaaguccuggaagaacaacauccugcgcacccaggagagcgagugcgugugcgugaacggguccugcuucacggucaugaccgacggccccagcaacggccaggcguccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccguggguguccuucaaccagaaccucgaguaccagaucggguacaucugcagcggcguguucggggacaacccccgccccaacgacaagaccggcuccugcggccccgucagcuccaacggggccaacggcgugaagggguucagcuucaaguacggcaacgggguguggaucggccggaccaaguccaucagcagccgcaacggcuucgagaugaucugggacccgaacggguggaccggcaccgacaacaacuucuccaucaagcaggacaucaucgggaucaacgaguggagcggcuacuccgggagcuucguccagcaccccgagcugaccggcauggacugcauccggcccugcuucuggguggagcugauccgcggccggcccaaggagaacacgaucuggaccuccgggagcuccaucagcuucugcggcgucaacuccgacaccgugggguggagcuggccggacggcgccgagcuccccuucaccaucgacaaguga

SEQ ID NO: 86817 - RNA, 1401 nt, Artificial Sequence
  derived and/or modified sequence opt1 from neuraminidase__InfluenzaA__AIR94118
augaaccccaaccagaagaucaucgccaucggcagcgugucccugaucaucgccaucaucugccuccugaugcagaucgcgauccugaccaccacgaugacccuccacuuccgccagaacgagugcaacaacagcuccaacaaccaggucaugccgugcgagcccaucaucaucgagcggaacaccgugcaccugaacagcaccacgaucgagcgcgagaucugccccaagguggccgaguacaagaacugguccaagccccagugccagaucaccggguucgccccguucagcaaggacaacuccauccggcugagcgccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugcccuuccaccucgggaccaagcaggucugcaucgcguggagcuccagcuccugcuacgacggcaaggccuggcugcacaucugcgugaccggggacgacaagaacgccaccgccagcaucaucuacaacggcaugcugguggacuccaucgggagcugguccaagaacauccuccggacgcaggagagcgagugcgucugcaucaacgggaccugcgcgguggugaugaccgacggcagcgccuccggcaaggccgacacccgcguccuguucaucaaggagggcaagaucaucaacaucagcccgcuguccgggagcgcccagcacguggaggagugcuccugcuacccccgguaccccgaggugcgcugcgucugccgggacaacuggaagggcagcaaccgccccauccucuacaucaacauggccgacuacuccaucgagagcuccuacgugugcagcggccuggugggggacacgccgcggaacgacgacuccagcuccagcuccaacugcaaggaccccaacagcgagcgcggcgcgcccggggucaagggcugggccuucgacgacgggaacgacguguggaugggccggaccaucaagaacggcucccgcagcggguacgagaccuuccggguggucaacggcuggaccguggccaacuccaagagccaggugaaccgccaggucaucguggacagcgacgacugguccggguacagcggcaucuucuccgucgaggggaagaagugcaucaaccggugcuucuacguggagcugauccgcggccggccccaggagccgcgcgugugguggacgagcaacuccaucaucgucuucugcggcaccagcgggaccuacggcaccggguccuggcccgacggcgccaacaucaacuucaugcccaucuga

SEQ ID NO: 86818 - RNA, 1410 nt, Artificial Sequence
  derived and/or modified sequence opt1 from neuraminidase__InfluenzaA__AIT38335
augaaccccaaccagaagaucaucaccaucggcagcgugucccugaccaucgccacgaucugcuuccucaugcagaucgccauccuggucaccaccgugacccugcacuucaagcaguacgagugcaacagcccgcccacgaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcgcccuucagcaaggacaacuccauccgccucagcgccggcggggacaucugggugacccgggagcccuacgucuccugcgaccccgacaagugcuaccaguucgcccugggccaggggacgacccugaacaaccgccacagcaacgacaccgugcacgaccggaccccguaccgcacgcuccugaugaacgagcugggcauccccuuccaccucggcaccaagcaggucugcaucgccugguccagcuccagcugccacgacgggaaggccuggcugcacgugugcgugaccggccacgacgagaacgcgaccgccuccuucaucuacgacgggcggcugguggacagcaucgucuccuggagcaagcgcauccuccggacgcaggaguccgagugcgugugcaucgacgggaccugcaccguggucaugaccgacgggagcgccuccggccgcgccgacacgcggauccuguucaucaaggagggcaagaucauccacaucagccagcugagcggguccgcgcagcacguggaggagugcagcugcuacccccgcuaccccggcgugcggugcgucugccgcgacaacuggaagggguccaaccggccgaucguggacaucaacgugaaggacuacagcaucaacuccagcuacgucugcuccggccucgugggcgacacgccccgcaagaacgacagcuucuccagcuccuacugccugaaccccaacaacgaggagggcggccacggggugaagggcugggccuucgacgacggggacgacgucuggaugggccggaccaucaacgagaagcugcgcagcggcuacgagaccuucaaggugaucaaggggugguccaagcccaacagcaagcuccagaucaaccggcaggucaucguggaccgcggcaaccgguccggguacagcggcaucuucuccguggaggggaagggcugcaucaaccgcugcuucuacgucgagcugauccgcggccggaagcaggagaccgaggugugguggaccagcaacuccaucguggucuucugcgggaccagcggcaccuacgggacgggcagcuggccggacggggccaacaucaaccugaugcccaucuga

SEQ ID NO: 86819 - RNA, 1410 nt, Artificial Sequence
  derived and/or modified sequence opt1 from neuraminidase__InfluenzaA__AIT38346
augaaccccaaccagaagaucaucaccaucggcagcaucucccugaccaucgccacgaucugcuuccuccuccagguggccauccuggucaccaccgugacccugcacuucaagcaguucgagugcaacccgacgcccaacaaccaggugaugcugugcgagcccaccgucaucgagcgcaacaucaccaagaucguguaccugaccaacacgaccguggagaaggagaucugccccaagccggcggaguaccggaacuggagcaagccccagugcaagaucaccggguucgcccccuucuccaaggacaacagcauccgccucuccgccggcggggacaucugggucacccgggagcccuacgugagcugcgccccgaacaagugcuaccaguucgcccugggccaggggacgacccugaacaaccgccacuccaacgacaccgugcacgaccggacccccuaccgcacgcuccugaugaacgagcugggcauccccuuccaccucggcaccaagcaggucugcaucgcguggagcuccagcuccugccacgacgggaaggccuggcugcacgugugcgugaccggccacgacaagaacgccaccgccagcuucaucuacgacgggcggcuggucgacuccaucggcagcugguccaagaacauccuccgcacgcaggagagcgagugcgugugcaucaacgggaccugcaccguggucaugaccgacggcuccgcgagcggccgggccgacacgaagauccuguucaucaaggaggggaagaucauccacaucucccagcugagcggcagcgcccagcacguggaggagugcuccugcuacccccgcuacccgggggugcggugcgucugccgcgacaacuggaagggcagcaaccggcccaucguggacaucaacgugcgcgacuacuccaucgucagcuccuacgugugcagcggccucgugggggacacgccccggaagaacgacuccuucagcuccagccacugccugaaccccaacaacgaggagggcgggcacggcgucaaggggugggccuucgacgacggcgacgacguguggaugggccgcaccaucuccgagaagcugcggagcggguacgagaccuucaaggucaucaagggcugguccaagccgaacagcaagcuccagaucaaccgccaggugaucguggaccgggggaaccgcuccggcuacagcgggaucuucuccgucgagggcaagagcugcaucaaccggugcuucuacguggagcugauccgcggccgcaagcaggagaccgaggugugguggaccuccaacagcaucgucguguucugcgggaccagcggcaccuacgggacgggcuccuggcccgacggggccgacaucaaccugaugcccaucuga

SEQ ID NO: 86820 - RNA, 1410 nt, Artificial Sequence
  derived and/or modified sequence opt1 from neuraminidase__InfluenzaA__AIT38361
augaaccccaaccagaagaucaucaccaucggcagcaucucccugaccaucgccacgaucugcuuccucaugcaggucgccauccuggugaccaccgugacccugcacuucaagcaguacgagugcaacagcacgccgaacaaccaggugaugcucugcgagcccaccgucaucgagcgcaacaucaccaagaucguguaccugaccaacacgaccguggucaaggaggugugccccaagcccgcggaguaccggaacugguccaagccgcagugcaagaucaccggguucgcccccuucagcaaggacaacuccauccgccugagcgccggcggggacaucugggugacccgggagcccuacgucuccugcgcccccaacaagugcuaccaguucgcccucggccaggggacgacccugaacaaccgccacagcaacgacaccgugcacgaccggaccccguaccgcacgcugcucaugaacgagcugggcauccccuuccaccugggcaccaagcaggucugcaucgcgugguccagcuccagcugcuacgacgggaaggccuggcuccacgugugcgugaccggccacgacaagaacgccaccgccuccuucaucuacgacgggcggcugguggacagcaucggcuccuggagcaagaacauccugcgcacgcaggaguccgagugcgucugcaucaacgggaccugcaccguggugaugaccgacggcagcgcguccggccgggccgacacgaagauccucuucaucaaggaggggaagaucauccacaucagccagcugagcggcuccgcccagcacgucgaggagugcagcugcuacccccgcuaccccggggugcggugcgugugccgcgacaacuggaagggcuccaaccggccgaucgucgacaucaacaugcgcgacuacagcaucguguccagcuacgugugcuccggccuggucggggacacgccccgggagaacgacagcuucuccagcucccacugccucaaccccaacaacgaggagggcgggcacggcgugaaggggugggccuucgacgacggcgacgacgucuggaugggccgcaccaucagcgagaagcugcgguccggguacgagaccuucaaggugaucaagggcuggagcaagcccaacuccaagcugcagaucaaccgccaggugaucgucgaccgggggaaccgcagcggcuacuccgggaucuucagcguggagggcaaguccugcaucaaccggugcuucuacguggagcucauccgcggccgcaagcaggagaccgaggucugguggaccagcaacagcaucgugguguucugcgggaccuccggcaccuacgggacgggcagcuggccggacggggccgacaucaaccugaugcccaucuga

SEQ ID NO: 86821 - RNA, 1410 nt, Artificial Sequence
  derived and/or modified sequence opt1 from neuraminidase__InfluenzaA__AIT38375
augaaccccaaccagaagaucaucaccaucggcagcgugugcaugaccaucgggauggucaaccugauccuccagaucggcaacaucaucuccaucuggaucagccacuccauccagcuggggaaccagaaccagaucgagaucugcaaccagagcgugaucacguacgagaacaacaccugggugaaccagaccuacgucaacaucuccaacaccaacuucgccgccggccagagcguggugccggucaagcuggcggggaacuccagccucugcuccgugagcggcugggccaucuacuccaaggacaacagcauccgcaucggcuccaagggggacguguucgucauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcguggccugguccgccagcgcgugccacgacgggaucaacuggcucacgaucggcaucuccggccccgacaacggggccgucgccgugcugaaguacaacggcaucaucaccgacaccaucaagagcuggcgcaacaacauccugcggacccaggaguccgagugcgccugcgugaacgggagcugcuucacggucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 86822 - RNA, 1410 nt, Artificial Sequence
  derived and/or modified sequence opt1 from neuraminidase__InfluenzaA__AIT93148
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaaguucagcaucaagcaggacaucgucgggaucaacgagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 86823 - RNA, 1410 nt, Artificial Sequence; identical to SEQ ID NO: 79648
  derived and/or modified sequence opt1 from neuraminidase__InfluenzaA__AIU39701

SEQ ID NO: 86824 - RNA, 1410 nt, Artificial Sequence; identical to SEQ ID NO: 77746
  derived and/or modified sequence opt1 from neuraminidase__InfluenzaA__AIU39703

SEQ ID NO: 86825 - RNA, 1410 nt, Artificial Sequence
  derived and/or modified sequence opt1 from neuraminidase__InfluenzaA__AIU39705
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaacaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86826 - RNA, 1413 nt, Artificial Sequence
  derived and/or modified sequence opt1 from neuraminidase__InfluenzaA__AIU46611
augaaccccaaccagaagaucacgugcaucagcgccaccggcaugacccuguccguggucagcaugcucaucgggaucgccaaccugggccugaacaucgggcuccacuacaaggugggcgacuccaccaacaucaacaucccgaacaugaacgagaccagccccaccacgaccaucaucaacaaccacccccagaacaacuucaccaacaucaccaacaucaucgugacgcgcaacgaggaggggcaccuccugaaccugaccaagccccugugcgaggucaacuccuggcacauccugagcaaggacaacgcgauccggaucggcgaggacgcccacaucaucgugacccgcgagccguaccucuccugcgacccccagggcugccggauguucgcccugagccaggggaccacgcugcgcggcaagcacgccaacgggaccauccacgaccggucccccuuccgcgcccucgugagcugggagaugggccaggcgcccuccccguacaacacccgggucgagugcaucggguggagcuccaccagcugccacgacggcaucucccgcaugagcaucugcaucuccggccccaacaacaacgccagcgccguggugugguacgggggccggcccgucacggagauccccuccugggccgggaacauccugcgcacccaggagagcgagugcgugugccacggcggcaucugcccgguggucaugaccgacgggcccgcgaacaaccgggccgagaccaagaucaucuacuucaaggagggcaagaucaagaagaucgaggagcugaagggggacgcccagcacaucgaggagugcagcugcuacggcgccuccgagaugaucaagugcaucugccgcgacaacuggaagggggccaaccggcccgugaucacgaucgaccccgagaugaugacccacaccagcaaguaccucugcuccaagauccugaccgacacgagccgcccgaacgaccccaccaacggcaacugcgaggcgcccaucaccggcgggucccccgacccgggcgugaagggguucgccuuccuggacggcgagaacagcuggcucgggcggaccaucuccaaggacagccgcuccggcuacgagaugcugaagguccccaacgccgagacggacacccagagcggcgccaucucccaccagaucaucgugaacaaccagaacuggagcggguacuccggcgccuucaucgacuacugggcgaacaaggagugcuucaaccccugcuucuacguggagcugauccgggggcgccccaaggagagcuccguccucuggaccagcaacuccaucguggcccugugcggcagcaaggagcggcugggguccuggagcuggcacgacggcgccgagaucaucuacuucaaguga

SEQ ID NO: 86827 - RNA, 1410 nt, Artificial Sequence
  derived and/or modified sequence opt1 from neuraminidase__InfluenzaA__AIV09221
augaaccccaaccagaagaucaucaccaucggcagcgugugcaugaccaucgggauggccaaccugauccuccagaucggcaacaucacguccaucuggaucagccacuccauccagaucgggaaccgcaaccagaucgaggccugcaaccagagcgucaucaccuacgagaacaacaccugggugaaccagaccuacgugaacaucuccaacacgaacuucgcggucggccagagcguggugccggucaagcuggccgggaacuccagccugugccccguguccggcugggccaucuacagcaaggacaacuccauccggaucggcagcaagggggacguguucgucauccgcgagcccuucaucuccugcagcccccucgagugccggaccuucuuccugacccagggcgcccugcucaacgacaagcacuccaacgggaccaucaaggaccgcagcccguaccggacgcugauguccugccccaucggcgaggugcccagccccuacaacucccgcuucgagagcguggccuggagcgcguccgccugccacgacgggaucaacuggcugaccaucggcaucagcggcccggacaacggggccgucgccgugcucaaguacaacggcaucaucaccgacaccaucaaguccuggcggaacaacauccugcgcacgcaggagagcgagugcgugugcgucaacggguccugcuucaccgugaugaccgacggccccagcaacggccaggcguccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggccguggguguccuucaaccagaaccuggaguaccagaucggguacaucugcagcggcaucuucggggacaacccccgccccaacgacaagaccggcuccugcggccccgucccgagcaacggggccaacggcgugaagggguucuccuucaaguacggcaacgggguguggaucggccggaccaagagcaucuccagccgcaacggcuucgagaugaucugggaccccaacggguggaccgagaccgacaacgacuucagcaucaagcaggacaucgucggcaucaacgagugguccggguacagcggcuccuucgugcagcaccccgagcucacggggcuggacugcauccggcccugcuucugggucgagcugauccgcggccggccgaaggagaacaccaucuggaccagcggcuccagcaucuccuucugcggggugaacagcaacaccguggacugguccuggcccgacggcgccgagcuccccuucacgaucgacaaguga

SEQ ID NO: 86828 - RNA, 1410 nt, Artificial Sequence
  derived and/or modified sequence opt1 from neuraminidase__InfluenzaA__AIW60703
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccagcuccagcugccacgacgggaaggccuggcugcacgugugcgugaccggccacgacgagaacgcgaccgccuccuucaucuacgacgggcggcuggucgacagcaucggcuccuggagcaagaagauccuccgcacccaggaguccgagugcgugugcaucaacgggacgugcaccguggucaugaccgacggcagcgccuccggccgggccgacaccaagauccuguucaucgaggaggggaagaucgugcacaucagcccccugagcggcuccgcgcagcacguggaggagugcagcugcuacccccaguacuccgggguccgcugcgugugccgggacaacuggaagggcagcaaccgcccgaucguggacaucaacgucaaggacuacuccaucgugagcuccuacgugugcagcggccucgucggggacacgccccggaagaacgacuccagcuccagcucccacugccugaaccccaacaacgaggagggcgggcacggcgugaaggggugggccuucgacgacggcaacgacgucuggaugggccgcaccaucagcgagaagcugcgguccggguacgagaccuucaaggugaucggcggguggagcaagcccaacuccaagcuccagaucaaccgccaggugaucgucgaccggggcaaccgcagcggguacuccggcaucuucagcguggagggcaagaacugcaucaaccggugcuucuacguggagcugauccgcgggcggaagcaggagaccgaggucugguggacgagcaacuccaucgugguguucugcggcaccagcgggaccuacggcaccggguccuggccggacggcgccgacaucaaccugaugcccaucuga

SEQ ID NO: 86829 - RNA, 1410 nt, Artificial Sequence
  derived and/or modified sequence opt1 from neuraminidase__InfluenzaA__AIW60704
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaaccgccacagcaacgacaucgugcacgaccggaccccguaccgcacccuccugaugaacgagcugggcgugcccuuccaccucggcaccaagcaggucugcaucgccugguccagcuccagcugccacgacgggaaggccuggcugcacgugugcgugacgggccacgacgagaacgcgaccgccuccuucaucuacgacgggcggcuggucgacagcaucggcuccuggagcaagaagauccuccgcacccaggaguccgagugcgugugcaucaacgggaccugcacgguggucaugaccgacggcagcgccuccggccgggccgacaccaagauccuguucaucgaggaggggaagaucgugcacaucagcccccugagcggcuccgcgcagcacguggaggagugcagcugcuacccccaguacuccgggguccgcugcgugugccgggacaacuggaagggcagcaaccgcccgaucguggacaucaacgucaaggacuacuccaucgugagcuccuacgugugcagcggccucgucggggacacgccccggaagaacgacuccagcuccagcucccacugccugaaccccaacaacgaggagggcgggcacggcgugaaggggugggccuucgacgacggcaacgacgucuggaugggccgcaccaucagcgagaagcugcgguccggguacgagaccuucaaggugaucggcggguggagcaagcccaacuccaagcuccagaucaaccgccaggugaucgucgaccggggcaaccgcagcggguacuccggcaucuucagcguggagggcaagaacugcaucaaccggugcuucuacguggagcugauccgcgggcggaagcaggagaccgaggucugguggaccagcaacuccaucgugguguucugcggcacgagcgggaccuacggcaccggguccuggccggacggcgccgacaucaaccugaugcccaucuga

SEQ ID NO: 86830 - RNA, 1410 nt, Artificial Sequence
  derived and/or modified sequence opt1 from neuraminidase__InfluenzaA__AIW60705
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaaguuccgcuccggguacgagaccuucaaggucaucggcggguggagcaagcccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugugguggacguccaacagcaucgucguguucugcggcaccuccgggaccuacggcaccgggagcuggccggacggcgccgacaucaaccugaugcccaucuga

SEQ ID NO: 86831 - RNA, 1410 nt, Artificial Sequence; identical to SEQ ID NO: 86830
  derived and/or modified sequence opt1 from neuraminidase__InfluenzaA__AIW60706

SEQ ID NO: 86832 - RNA, 1410 nt, Artificial Sequence
  derived and/or modified sequence opt1 from neuraminidase__InfluenzaA__AIW60708
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacaacgggcggcugguggacagcaucggcuccuggagcaagaagauccuccgcacccaggaguccgagugcgucugcaucaacgggacgugcaccguggugaugaccgacggcagcgccuccggcaaggcggacaccaagauccuguucaucgaggaggggaagaucguccacaucagcccccugagcggcuccgcccagcacguggaggagugcagcugcuacccccgguacccgggggugcgcugcgucugccgggacaacuggaagggcuccaaccgccccaucguggacaucaacgugaaggacuacagcaucgucuccagcuacgugugcuccggccucgugggggacacgccccggaagaacgacagcuccagcuccagccacugccugaaccccaacaacgaggagggcgggcacggcgucaaggggugggccuucgacgacggcaacgacguguggaugggccgcaccaucuccgagaagcugcggagcggguacgagaccuucaaggucaucgagggcugguccaacccgaacagcaagcuccagaucaaccgccaggugaucguggaccgggggaacuccagcggcuacuccgggaucuucagcgucgagggcaagagcugcaucaaccgcugcuucuacguggagcugauccggggccgcaagcaggagaccgaggugugguggacguccaacagcaucgucgugcugugcgggaccuccggcaccuacgggaccggcagcuggcccgacggggccgacaucaaccucaugcccaucuga

SEQ ID NO: 86833 - RNA, 1410 nt, Artificial Sequence
  derived and/or modified sequence opt1 from neuraminidase__InfluenzaA__AIW60710
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaccguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcacguacgggaccggcuccuggccggacggggccgacaucaaccucaugcccaucuga

SEQ ID NO: 86834 - RNA, 1410 nt, Artificial Sequence; identical to SEQ ID NO: 75599
  derived and/or modified sequence opt1 from neuraminidase__InfluenzaA__AIW60711

SEQ ID NO: 86835 - RNA, 1410 nt, Artificial Sequence; identical to SEQ ID NO: 75599
  derived and/or modified sequence opt1 from neuraminidase__InfluenzaA__AIW60712

SEQ ID NO: 86836 - RNA, 1410 nt, Artificial Sequence
  derived and/or modified sequence opt1 from neuraminidase__InfluenzaA__AIW60713
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgccuccagcuacgucugcuccggccuggugggcgacacgccccgcaagaacgacagcuccagcuccagccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacagcaagcugcagaucaaccggcaggucaucguggaccgcggcaaccgguccggguacagcggcaucuucagcguggaggggaaguccugcaucaaccgcugcuucuacgucgagcucauccggggccgcaaggaggagaccgaggugcuguggaccagcaacuccaucguggucuucugcggcaccagcgggacguacggcaccggguccuggccggacggcgccgacaucaaccugaugcccaucuga

SEQ ID NO: 86837 - RNA, 1410 nt, Artificial Sequence
  derived and/or modified sequence opt1 from neuraminidase__InfluenzaA__AIW60714
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgccuccagcuacgucugcuccggccuggugggcgacacgccccgcaagaacgacagcuccagcuccagccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacagcaagcugcagaucaaccggcaggucaucgugggccgcgggaaccgguccggcuacagcgggaucuucagcguggagggcaaguccugcaucaaccgcugcuucuacgucgagcucauccggggccgcaaggaggagaccgaggugcuguggaccagcaacuccaucguggucuucugcgggaccagcggcacguacgggaccggcuccuggccggacggggccgacaucaaccugaugcccaucuga

SEQ ID NO: 86838 - RNA, 1410 nt, Artificial Sequence
  derived and/or modified sequence opt1 from neuraminidase__InfluenzaA__AIW60715
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaagaagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 86839 - RNA, 1410 nt, Artificial Sequence; identical to SEQ ID NO: 77519
  derived and/or modified sequence opt1 from neuraminidase__InfluenzaA__AIW60716

SEQ ID NO: 86840 - RNA, 1410 nt, Artificial Sequence
  derived and/or modified sequence opt1 from neuraminidase__InfluenzaA__AIY54970
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaccgacuccagcuccagcucccacugccucgaccccaacaacgaggagggcgggcacggggucaagggcugggccuucgacgacgggaacgaccuguggaugggccggaccaucagccagaaccugcgcuccggcuacgagaccuucaaggugaucgagggguggagcaaccccaacuccaagcuccagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcuguggaccuccaacagcaucguggucuucugcggcacguccgggaccuacggcaccgggagcuggccggacggcgccgacaucaaccucaugcccaucuga

SEQ ID NO: 86841 - RNA, 1410 nt, Artificial Sequence
  derived and/or modified sequence opt1 from neuraminidase__InfluenzaA__AIY54974
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugagcgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaagguggaccggggcaaccgguccggguacagcggcaucuucagcgucgaggggaaguccugcaucaaccgcugcuucuacguggagcucauccggggccgcaaggaggagaccaaggugcuguggaccagcaacuccaucgucguguucugcggcaccagcgggacguacggcaccggguccuggccggacggcgccgacaucaaccugaugcccaucuga

SEQ ID NO: 86842 - RNA, 1410 nt, Artificial Sequence
  derived and/or modified sequence opt1 from neuraminidase__InfluenzaA__AIY54982
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaaguuccgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 86843 - RNA, 1410 nt, Artificial Sequence
  derived and/or modified sequence opt1 from neuraminidase__InfluenzaA__AIY54990
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgggaucaccggcuucgcgcccuucagcaaggacaacuccauccgccugagcgccgggggcgacaucugggucacccgggagcccuacguguccugcgaccccgacaagugcuaccaguucgcccucgggcagggcaccacgcugaacaacgugcacagcaacgacaccguccacgaccgcaccccguaccggacccugcucaugaacgagcugggcgugcccuuccaccuggggacgaagcaggucugcaucgccugguccagcuccagcugccacgacggcaaggccuggcuccacgugugcgugaccggggacgacaagaacgcgaccgccuccuucaucuacaacggccgccugguggacagcaucgucuccuggagcaaggagauccugcggacccaggaguccgagugcgugugcaucaacgggacgugcaccguggucaugaccgacggcagcgccagcggcaaggccgacaccaagauccucuucaucgaggaggggaagaucgugcacacguccacccugagcggcuccgcgcagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggagcggguacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcggccggaaggaggagaccgaggugcucuggaccagcaacuccaucgucguguucugcgggaccagcggcacguacgggaccggcuccuggccggacggggccgacaucaaccugaugcccaucuga

SEQ ID NO: 86844 - RNA, 1401 nt, Artificial Sequence
  derived and/or modified sequence opt1 from neuraminidase__InfluenzaA__AJD78177
augaaccccaaccagaagaucaucgccaucggcagcgugucccugaucaucgccgucaucugccuccugaugcagaucgcgauccugaccaccacgaugacccuccacuucaugcagaacgagugcagcaacccguccaacaaccaggugaugcccugcgagcccaucaucaucgagcgcaacaccgugcaccugaacaacaccacgaucgagcgggagaucugccccaaggccgccgaguacaagaacuggagcaagccgcagugccagaucaccggguucgcccccuucuccaaggacaacagcauccgccuguccgccggcggggacaucugggucacccgggagcccuacgugagcugcucccucgacaagugcuaccaguucgcgcugggccaggggaccacgcugaagaacaagcacagcaacggcaccacccacgaccgcacgccccaccggacccuccugaugaacgagcugggcgugccguuccaccucgggaccaagcaggucugcaucgccugguccagcuccagcugcuacgacggcaaggccuggcugcacaucugcgugaccggggacgacaagaacgccaccgcguccaucaucuacgacggcaugcugguggacagcaucggguccuggagcaagaacauccuccgcacgcaggaguccgagugcgucugcaucaacgggaccugcgccguggugaugaccgacggcagcgccagcggcaaggccgacacccggguccuguucauccgcgagggcaagaucaucaacaucagcccccuguccggguccgcccagcacguggaggagugcagcugcuacccccgguaccccgaggugcgcugcgucugccgggacaacuggaagggcuccaaccgcccgauccucuacaucaacauggcggacuacagcaucgaguccagcuacgugugcuccggccuggugggggacacgccccggaacgacgacagcuccagcuccagcaacugccgcgaccccaacaacgagcggggcgcccccggggucaagggcugggccuucgacgacgggaacgacguguggaugggccgcaccaucaagaacggcucccggagcggguacgagaccuuccgcguggucaacggcuggaccauggccaacuccaagagccagaucaaccgccaggugaucguggacuccgacgacuggagcggguacagcggcaucuucuccgucgaggggaagaagugcaucaaccggugcuucuacguggagcugauccggggccgcccgcaggagccccgcgucugguggacgagcaacuccaucaucguguucugcggcaccagcgggaccuacggcaccggguccuggcccgacggcgccaacaucaacuucaugcccaucuga

SEQ ID NO: 86845 - RNA, 1401 nt, Artificial Sequence
  derived and/or modified sequence opt1 from neuraminidase__InfluenzaA__AJD78189
augaaccccaaccagaagaucaucgccaucggcagcgugucccugaucaucgccaucaucugccuccugaugcagaucgcgauccugaccaccacgaugacccuccacuuccgccagaacgagugcaacaacagcuccaacaaccaggucaugccgugcgagcccaucaucaucgagcggaacaccgugcaccugaacagcaccacgaucgagcgcgagaucugccccaagguggccgaguacaagaacugguccaagccccagugccagaucaccggguucgccccguucagcaaggacaacuccauccggcugagcgccggcggggacaucugggucacccgcgagcccuacguguccugcagccucgacaagugcuaccaguucgcccugggccaggggaccacgcugaagaacaagcacuccaacggcaccacccacgaccggaccagccaccgcacgcuccugaugaacgagcugggcgugcccuuccaccucgggaccaagcaggucugcaucgcgugguccagcuccagcugcuacgacggcaaggccuggcugcacaucugcgugaccggggacgacaagaacgccaccgccuccaucaucuacaacggcaugcugguggacagcaucggguccuggagcaagaacauccuccggacgcaggagagcgagugcgucugcaucaacgggaccugcgcgguggugaugaccgacggcuccgccagcggcaaggccgacacccgcguccuguucauccgggagggcaagaucaucaacaucagcccccuguccggguccgcccagcacguggaggagugcagcugcuacccgcgcuaccccgaggugcggugcgucugccgcgacaacuggaagggcuccaaccggcccauccucuacaucaacauggccgacuacagcaucgaguccagcuacgugugcuccggccuggugggggacacgccccgcaacgacgacagcuccagcuccagcaacugcaaggacccgaacuccgagcggggcgcgcccggggucaagggcugggccuucgacgacgggaacgacguguggaugggccgcaccaucaagaacggcagccgguccggguacgagaccuuccgcgugcugaacggcuggaccgucgccaacagcaagagccagaucaaccgccaggugaucguggacuccgacgacuggagcggguacuccggcaucuucagcgucgaggggaagaagugcaucaaccggugcuucuacguggagcucauccggggccgcccccaggagccccgcgucugguggacguccaacagcaucaucguguucugcggcaccuccgggaccuacggcaccgggagcuggccggacggcgccaacaucaacuucaugcccaucuga

SEQ ID NO: 86846 - RNA, 1401 nt, Artificial Sequence
  derived and/or modified sequence opt1 from neuraminidase__InfluenzaA__AJD78201
augaaccccaaccagaagaucaccgccaucggcagcgugucccugaucaucgccaucaucugccuccugaugcagaucgcgauccugaccacgaccaugacccuccacuuccgccagaaggagugcagcaacccguccaacaaccaggucaugcccugcgagcccaucaucaucgagcggaacaccgugcaccugaacagcacgaccaucgagcgcgagaucugccccaagguggccgaguacaagaacugguccaagccgcagugccugaucaccggguucgcccccuucagcaaggacaacuccauccggcucagcgccggcggggacaucugggucacccgcgagcccuacguguccugcagccccgacaagugcuaccaguucgcccugggccaggggacgacccugaagaacaagcacuccaacggcaccacccacgaccggacgccgcaccgcacccuccugaugaacgagcugggcgugcccuuccaccucgggaccaagcaggucugcaucgcguggagcuccagcuccugcuacgacggcaaggccuggcugcacaucugcgugaccggggacgacaagaacgccacggccagcaucaucuacgacggcaugcugguggacuccaucgggagcugguccaagaacauccuccggacccaggagagcgagugcgucugcaucaacgggaccugcgcgguggugaugaccgacggcagcgccuccggcgucgccgacacgcgcgugcuguucauccgggagggcaagaucaucaacauccgcccccugagcggguccgcccagcacguggaggagugcagcugcuacccccgguacccggagguccgcugcgugugccgggacaacuggaagggcuccaaccgccccaucaucuacaucaacauggccgacuacagcaucgaguccagcuacgugugcuccggccucgucggggacacgccccggaacgacgacagcuccagcuccagcaacugccgcgaccccaacaacgagcggggcgcgccgggggugaagggcugggccuucgacgacgggaacgacguguggaugggccgcaccaucaagaacggcucccggagcggguacgagaccuuccgcgucaucaacggcuggaccauggccaacuccaagagccagaucaaccgccaggugaucguggacuccgacgacuggagcggguacagcggcaucuucuccgucgaggggaagaagugcaucaaccggugcuucuacguggagcugauccgcggccggccccaggagccccgcgucugguggaccagcaacuccaucaucguguucugcggcaccagcgggaccuacggcacgggguccuggcccgacggcgccaacaucaacuucaugccgaucuga

SEQ ID NO: 86847 - RNA, 1401 nt, Artificial Sequence
  derived and/or modified sequence opt1 from neuraminidase__InfluenzaA__AJD78213
augaaccccaaccagaagaucaccgccaucggcagcgugucccugaucaucgccaucaucugccucuucaugcagaucgcgauccugaccacgaccaugacccugcacuuccgccagaaggagugcagcaacccguccaacaaccaggucaugcccugcgagcccaucaucaucgagcggaacaccgugcaccucaacagcacgaccaucgagcgcgagaucugccccaagguggccgaguacaagaacugguccaagccgcagugccugaucaccggguucgcccccuucagcaaggacaacuccauccggcugagcgccggcggggacaucugggucacccgcgagcccuacguguccugcagccccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggagcuccagcuccugcuacgacggcaaggccuggcuccacaucugcgugaccggggacgacaagaacgccacggccagcaucaucuacgacggcaugcugguggacuccaucgggagcugguccaagaacauccugcggacccaggagagcgagugcgucugcaucaacgggaccugcgcgguggugaugaccgacggcagcgccuccggcgucgccgacacgcgcguccucuucauccgggagggcaagaucaucaacauccgcccccugagcggguccgcccagcacguggaggagugcagcugcuacccccgguacccggaggugcgcugcgugugccgggacaacuggaagggcuccaaccgccccaucaucuacaucaacauggccgacuacagcaucgaguccagcuacgugugcuccggccuggucggggacacgccccggaacgacgacagcuccagcuccagcaacugccgcgaccccaacaacgagcggggcgcgccgggggugaagggcugggccuucgacgacgggaacgacguguggaugggccgcaccaucaagaacggcucccggagcggguacgagaccuuccgcgucaucaacggcuggaccauggccaacuccaagagccagaucaaccgccaggugaucguggacuccgacgacuggagcggguacagcggcaucuucuccgucgaggggaagaagugcaucaaccggugcuucuacguggagcucauccgcggccggccccaggagccccgcgucugguggaccagcaacuccaucaucguguucugcggcaccagcgggaccuacggcacgggguccuggcccgacggcgccaacaucaacuucaugccgaucuga

SEQ ID NO: 86848 - RNA, 1410 nt, Artificial Sequence; identical to SEQ ID NO: 83930
  derived and/or modified sequence opt1 from neuraminidase__InfluenzaA__AJI80140

SEQ ID NO: 86849 - RNA, 1410 nt, Artificial Sequence; identical to SEQ ID NO: 83930
  derived and/or modified sequence opt1 from neuraminidase__InfluenzaA__AJI80152

SEQ ID NO: 86850 - RNA, 1410 nt, Artificial Sequence; identical to SEQ ID NO: 86706
  derived and/or modified sequence opt1 from neuraminidase__InfluenzaA__AJI80164

SEQ ID NO: 86851 - RNA, 1410 nt, Artificial Sequence; identical to SEQ ID NO: 86645
  derived and/or modified sequence opt1 from neuraminidase__InfluenzaA__AJI80175

SEQ ID NO: 86852 - RNA, 1410 nt, Artificial Sequence; identical to SEQ ID NO: 86645
  derived and/or modified sequence opt1 from neuraminidase__InfluenzaA__AJI80187

SEQ ID NO: 86853 - RNA, 1410 nt, Artificial Sequence; identical to SEQ ID NO: 86645
  derived and/or modified sequence opt1 from neuraminidase__InfluenzaA__AJI80199

SEQ ID NO: 86854 - RNA, 1410 nt, Artificial Sequence; identical to SEQ ID NO: 86645
  derived and/or modified sequence opt1 from neuraminidase__InfluenzaA__AJI80211

SEQ ID NO: 86855 - RNA, 1410 nt, Artificial Sequence; identical to SEQ ID NO: 84879
  derived and/or modified sequence opt1 from neuraminidase__InfluenzaA__AJI80223

SEQ ID NO: 86856 - RNA, 1410 nt, Artificial Sequence; identical to SEQ ID NO: 86645
  derived and/or modified sequence opt1 from neuraminidase__InfluenzaA__AJI80235

SEQ ID NO: 86857 - RNA, 1410 nt, Artificial Sequence; identical to SEQ ID NO: 84879
  derived and/or modified sequence opt1 from neuraminidase__InfluenzaA__AJI80247

SEQ ID NO: 86858 - RNA, 1410 nt, Artificial Sequence; identical to SEQ ID NO: 86664
  derived and/or modified sequence opt1 from neuraminidase__InfluenzaA__AJI80259

SEQ ID NO: 86859 - RNA, 1410 nt, Artificial Sequence; identical to SEQ ID NO: 83154
  derived and/or modified sequence opt1 from neuraminidase__InfluenzaA__AJI80271

SEQ ID NO: 86860 - RNA, 1410 nt, Artificial Sequence; identical to SEQ ID NO: 86645
  derived and/or modified sequence opt1 from neuraminidase__InfluenzaA__AJI80283

SEQ ID NO: 86861 - RNA, 1410 nt, Artificial Sequence
  derived and/or modified sequence opt1 from neuraminidase__InfluenzaA__AJI80306
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccuggaccgcacccccuaccggacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccgccugguggacuccguggucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccucgaccccaacaacgaggagggcgggcacggcgucaaggggugggccuucgacgacggcaacgacguguggaugggccggaccaucaacgagacgagccgccugggguacgagaccuucaaggucaucgagggcugguccaaccccaagagcaagcugcagaucaacaagcaggucaucguggaccgcggggaccgguccggcuacagcgggaucuucuccguggagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 86862 - RNA, 1410 nt, Artificial Sequence
  derived and/or modified sequence opt1 from neuraminidase__InfluenzaA__AJI80318
augaaccccaaccagaagaucaucaccaucggcagcgugugcaugaccaucgggauggccaaccugauccuccagaucggcaacaucaucuccaucuggaucagccacuccauccagcuggggaaccagagccagaucgaggccugcaaccagaacgucaucacguacgagaacaacaccugggugaaccagaccuacgugaacaucuccaacaccaacuucgcgacgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggaagaacaacauccugcgcacgcaggagagcgagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcguguucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 86863 - RNA, 1410 nt, Artificial Sequence
  derived and/or modified sequence opt1 from neuraminidase__InfluenzaA__AJI80329
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 86864 - RNA, 1410 nt, Artificial Sequence
  derived and/or modified sequence opt1 from neuraminidase__InfluenzaA__AJI80340
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacuccggggccguggccguccugaaguacaacggcaucaucaccgacaccaucaagagcuggaagaacaacauccugcgcacgcaggaguccgagugcgcgugcgugaacgggagcugcuucaccaucaugaccgacggcccguccgacggccaggccagcuacaagaucuuccggaucgagaaggggaagaucgugaaguccgucgagaugaacgcccccaacuacuacuacgaggagugcagcugcuaccccgacuccagcgagaucacgugcgugugccgcgacaacuggcacggcuccaaccggcccugggugagcuucaaccagaaccucgaguaccagaucggguacaucugcuccggcaucuucggggacaacccgcgccccaacgacaagaccggcagcugcggccccgucuccagcaacggggccaacggcgugaagggguucagcuucaaguacggcaacgggguguggaucggccggaccaaguccaucagcucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 86865 - RNA, 1410 nt, Artificial Sequence; identical to SEQ ID NO: 83154
  derived and/or modified sequence opt1 from neuraminidase__InfluenzaA__AJI80351

SEQ ID NO: 86866 - RNA, 1410 nt, Artificial Sequence
  derived and/or modified sequence opt1 from neuraminidase__InfluenzaA__AJI80363
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacaacaccgcccgcgaccggaccccguaccgcacccugcucaugaacgagcugggcguccccuuccaccuggggacgaagcaggucugcaucgccuggagcuccagcuccugccacgacggcaaggcguggcuccacgugugcaucaccggggacgacaagaacgccaccgccagcuucaucuacaacggccggcugguggacuccguggugagcugguccaaggagauccugcgcacccaggagagcgagugcgucugcaucaacgggacgugcaccguggugaugaccgacggcuccgccagcggcaaggcggacaccaagauccucuucaucgaggaggggaagaucguccacacgagcacccuguccggcggggcccagcacguggaggagugcagcugcuacccccgguaccccggcgugcgcugcgucugccgggacaacuggaagggcuccaaccgcccgaucguggacaucaacaucaaggaccacagcaucguguccagcuacgucugcuccgggcuggugggcgacacgccccggaagaacgacagcuccagcuccagccacugccucaaccccaacaacgaggagggcgggcacggggugaagggcugggccuucgacgacggcaacgacgucuggauggggcgcaccaucaacgagaccucccggcugggcuacgagaccuucaaggugaucgagggguggagcaaccccaaguccaagcugcagaucaaccgccaggucaucguggaccggggcgaccgcagcggguacuccggcaucuucagcguggagggcaaguccugcaucaaccggugcuucuacgucgagcucauccgcgggcggaaggaggagaccgaggugcuguggaccagcaacagcaucguggucuucugcggcacguccgggaccuacggcaccgggagcuggccggacggcgccgaccugaaccucaugcccaucuga

SEQ ID NO: 86867 - RNA, 1410 nt, Artificial Sequence
  derived and/or modified sequence opt1 from neuraminidase__InfluenzaA__AJI80375
augaaccccaaccagaagaucaucaccaucggcagcgugucccugaccaucagcacgaucugccucuucaugcagaucgccauccugaucaccaccgucacccugcacuucaagcagcacgaguucaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 86868 - RNA, 1410 nt, Artificial Sequence; identical to SEQ ID NO: 86684
  derived and/or modified sequence opt1 from neuraminidase__InfluenzaA__AJI80387

SEQ ID NO: 86869 - RNA, 1410 nt, Artificial Sequence; identical to SEQ ID NO: 86684
  derived and/or modified sequence opt1 from neuraminidase__InfluenzaA__AJI80398

SEQ ID NO: 86870 - RNA, 1410 nt, Artificial Sequence; identical to SEQ ID NO: 86684
  derived and/or modified sequence opt1 from neuraminidase__InfluenzaA__AJI80409

SEQ ID NO: 86871 - RNA, 1410 nt, Artificial Sequence; identical to SEQ ID NO: 86684
  derived and/or modified sequence opt1 from neuraminidase__InfluenzaA__AJI80420

SEQ ID NO: 86872 - RNA, 1410 nt, Artificial Sequence; identical to SEQ ID NO: 86684
  derived and/or modified sequence opt1 from neuraminidase__InfluenzaA__AJI80431

SEQ ID NO: 86873 - RNA, 1410 nt, Artificial Sequence; identical to SEQ ID NO: 86679
  derived and/or modified sequence opt1 from neuraminidase__InfluenzaA__AJI80442

SEQ ID NO: 86874 - RNA, 1410 nt, Artificial Sequence; identical to SEQ ID NO: 86684
  derived and/or modified sequence opt1 from neuraminidase__InfluenzaA__AJI80454

SEQ ID NO: 86875 - RNA, 1410 nt, Artificial Sequence; identical to SEQ ID NO: 86679
  derived and/or modified sequence opt1 from neuraminidase__InfluenzaA__AJI80465

SEQ ID NO: 86876 - RNA, 1410 nt, Artificial Sequence; identical to SEQ ID NO: 86684
  derived and/or modified sequence opt1 from neuraminidase__InfluenzaA__AJI80477

SEQ ID NO: 86877 - RNA, 1410 nt, Artificial Sequence; identical to SEQ ID NO: 86684
  derived and/or modified sequence opt1 from neuraminidase__InfluenzaA__AJI80488

SEQ ID NO: 86878 - RNA, 1410 nt, Artificial Sequence; identical to SEQ ID NO: 86706
  derived and/or modified sequence opt1 from neuraminidase__InfluenzaA__AJI80499

SEQ ID NO: 86879 - RNA, 1410 nt, Artificial Sequence; identical to SEQ ID NO: 86684
  derived and/or modified sequence opt1 from neuraminidase__InfluenzaA__AJI80510

SEQ ID NO: 86880 - RNA, 1410 nt, Artificial Sequence; identical to SEQ ID NO: 86706
  derived and/or modified sequence opt1 from neuraminidase__InfluenzaA__AJI80521

SEQ ID NO: 86881 - RNA, 1410 nt, Artificial Sequence
  derived and/or modified sequence opt1 from neuraminidase__InfluenzaA__AJJ98767
augaaccccaaccagaagaucaucaccaucggcagcgugucccugaccaucagcacgaucugcuucuucaugcagaucgccauccucaucaccaccgucacccugcacuucaagcaguacgaguucaacuccccgagcaacaaccaggugaugcugugcgagcccacgaucaucgagcgcaacaucaccgagaucguguaccucaccaacaccacgaucgagaaggagaagugccccaagcccgccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccugggccaggggaccacgcucaacaacgugcacagcaacaacaccguccgcgaccggaccccguaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacggggacgacguguggaugggccgcaccaucuccgagaagucccggcucggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgacgugcucuggaccagcaacuccaucgucguguucugcggcaccagcgggacguacggcaccggguccuggccggacggcgccgacaucaaccugaugcccaucuga

SEQ ID NO: 86882 - RNA, 1410 nt, Artificial Sequence
  derived and/or modified sequence opt1 from neuraminidase__InfluenzaA__AJJ98779
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacgacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccaucgugagcuggacgaaggagauccugcgcacccaggaguccgagugcgucugcaucaacgggaccugcaccguggugaugacggacgggagcgccuccggcaaggccgacaccaagauccuguucaucgaggagggcaagaucguccacaccagcacccucagcggguccgcgcagcacguggaggagugcagcugcuacccccgguacccgggcgugcgcugcgucugccgggacaacuggaagggguccaaccgccccaucguggacaucaacaucaaggaccacagcaucguguccagcuacgucugcuccggccuggugggcgacacgccccggaagaacgacagcuccagcuccagccacugccuggaccccaacaacgaggagggcggccacggggugaagggcugggccuucgacgacgggaacgacgucuggaugggccgcaccaucuccgagaagucccggcucggcuacgagaccuucaaggugaucgagggguggagcaaccccaagagcaagcugcagaucaaccgccaggucaucguggaccggggcaaccgcuccggguacagcggcaucuucuccguggagggcaagagcugcaucaaccggugcuucuacgucgagcugauccgcgggcggaaggaggagaccgaggugcucuggacgagcaacuccaucguggucuucugcggcaccagcgggaccuacggcaccggguccuggccggacggcgccgacaucaaccugaugcccaucuga

SEQ ID NO: 86883 - RNA, 1410 nt, Artificial Sequence; identical to SEQ ID NO: 83154
  derived and/or modified sequence opt1 from neuraminidase__InfluenzaA__AJJ98791

SEQ ID NO: 86884 - RNA, 1410 nt, Artificial Sequence
  derived and/or modified sequence opt1 from neuraminidase__InfluenzaA__AJJ98803
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgacaccaagauccuguucaucgaggaggggaagaucgugcacaccagcacgcucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 86885 - RNA, 1410 nt, Artificial Sequence; identical to SEQ ID NO: 83154
  derived and/or modified sequence opt1 from neuraminidase__InfluenzaA__AJJ98815

SEQ ID NO: 86886 - RNA, 1410 nt, Artificial Sequence
  derived and/or modified sequence opt1 from neuraminidase__InfluenzaA__AJJ98827
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacaacaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 86887 - RNA, 1410 nt, Artificial Sequence; identical to SEQ ID NO: 82151
  derived and/or modified sequence opt1 from neuraminidase__InfluenzaA__AJJ98839

SEQ ID NO: 86888 - RNA, 1410 nt, Artificial Sequence; identical to SEQ ID NO: 80526
  derived and/or modified sequence opt1 from neuraminidase__InfluenzaA__AJJ98851

SEQ ID NO: 86889 - RNA, 1410 nt, Artificial Sequence
  derived and/or modified sequence opt1 from neuraminidase__InfluenzaA__AJJ98863
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgagcggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcaucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaugaaggaccacuccaucgugagcuccuacgucugcagcggccuggugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggagcaacccgaaguccaagcugcagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcucuggaccuccaacagcaucguggucuucugcggcaccuccgggacguacggcaccgggagcuggcccgacggcgccgacaucaaccugaugcccaucuga

SEQ ID NO: 86890 - RNA, 1410 nt, Artificial Sequence
  derived and/or modified sequence opt1 from neuraminidase__InfluenzaA__AJJ98875
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacgacaccguccgcaaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggagcaacccgaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugcccaucuga

SEQ ID NO: 86891 - RNA, 1410 nt, Artificial Sequence
  derived and/or modified sequence opt1 from neuraminidase__InfluenzaA__AJJ98887
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgacgugcuguggaccuccaacagcaucguggucuucugcggcaccuccgggacguacggcaccgggagcuggccggacggcgccgacaucaaccugaugcccaucuga

SEQ ID NO: 86892 - RNA, 1410 nt, Artificial Sequence
  derived and/or modified sequence opt1 from neuraminidase__InfluenzaA__AJJ98899
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcaaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 86893 - RNA, 1410 nt, Artificial Sequence; identical to SEQ ID NO: 83154
  derived and/or modified sequence opt1 from neuraminidase__InfluenzaA__AJJ98911

SEQ ID NO: 86894 - RNA, 1410 nt, Artificial Sequence; identical to SEQ ID NO: 83930
  derived and/or modified sequence opt1 from neuraminidase__InfluenzaA__AJJ98923

SEQ ID NO: 86895 - RNA, 1410 nt, Artificial Sequence
  derived and/or modified sequence opt1 from neuraminidase__InfluenzaA__AJJ98935
augaaccccaaccagaagaucaucaccaucggcagcgugucccugaccaucagcacgaucugcuucuucaugcagaucgccauccucaucaccaccgucacccugcacuucaagcgcuacgaguucaacuccccgcccaacaaccaggugaugcugugcgagcccacgaucaucgagcggaacaucaccgagaucguguaccucaccaacaccacgaucgagaaggagaucugccccaagccggccgaguaccgcaacuggagcaagccccagugcgggaucaccggcuucgcgcccuucuccaaggacaacagcauccggcuguccgccgggggcgacaucugggucacccgcgagcccuacgugagcugcgacccggacaagugcuaccaguucgcccuggggcagggcaccacgcucaacaacgugcacuccaacaacaccguccgggaccgcacccccuaccggacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86896 - RNA, 1410 nt, Artificial Sequence
  derived and/or modified sequence opt1 from neuraminidase__InfluenzaA__AJJ98947
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugacgcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcaacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgaccugaaccucaugcccaucuga

SEQ ID NO: 86897 - RNA, 1410 nt, Artificial Sequence
  derived and/or modified sequence opt1 from neuraminidase__InfluenzaA__AJJ98971
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 86898 - RNA, 1410 nt, Artificial Sequence
  derived and/or modified sequence opt1 from neuraminidase__InfluenzaA__AJJ98995
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaucguccgcgaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcaccuccggcacguacgggaccggcagcuggcccgacggggccgaccugaaccugaugcccaucuga

SEQ ID NO: 86899 - RNA, 1410 nt, Artificial Sequence; identical to SEQ ID NO: 82151
  derived and/or modified sequence opt1 from neuraminidase__InfluenzaA__AJJ99007

SEQ ID NO: 86900 - RNA, 1410 nt, Artificial Sequence
  derived and/or modified sequence opt1 from neuraminidase__InfluenzaA__AJJ99019
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcaacuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucuccgagaagucccgguucggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggccggacggcgccgacaucaaccugaugcccaucuga

SEQ ID NO: 86901 - RNA, 1410 nt, Artificial Sequence
  derived and/or modified sequence opt1 from neuraminidase__InfluenzaA__AJJ99031
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgaucaacaacgugcacuccaacgacaccguccgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 86902 - RNA, 1410 nt, Artificial Sequence
  derived and/or modified sequence opt1 from neuraminidase__InfluenzaA__AJJ99043
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagucccgcagcggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 86903 - RNA, 1410 nt, Artificial Sequence
  derived and/or modified sequence opt1 from neuraminidase__InfluenzaA__AJJ99067
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcggccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggacauccugcgcacccaggagagcgagugcgugugcaucaacggcacgugcaccguggucaugaccgacggcuccgccagcgggaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaagggcagcaaccgccccaucguggacaucaacaucaaggaccacuccaucgucagcuccuacgugugcagcgggcuggugggcgacaccccgcggaagaacgacuccagcuccagcucccacugccuggaccccaacaacgaggagggcgggcacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 86904 - RNA, 1410 nt, Artificial Sequence
  derived and/or modified sequence opt1 from neuraminidase__InfluenzaA__AJJ99079
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcaaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 86905 - RNA, 1410 nt, Artificial Sequence
  derived and/or modified sequence opt1 from neuraminidase__InfluenzaA__AJJ99091
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgaccucuggaugggccgcaccaucaacgagacgagccggcugggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggcccgacggggccgaccugaaccucaugcccaucuga

SEQ ID NO: 86906 - RNA, 1410 nt, Artificial Sequence
  derived and/or modified sequence opt1 from neuraminidase__InfluenzaA__AJJ99103
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcaaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugaugcccaucuga

SEQ ID NO: 86907 - RNA, 1410 nt, Artificial Sequence; identical to SEQ ID NO: 86373
  derived and/or modified sequence opt1 from neuraminidase__InfluenzaA__AJJ99115

SEQ ID NO: 86908 - RNA, 1410 nt, Artificial Sequence; identical to SEQ ID NO: 85293
  derived and/or modified sequence opt1 from neuraminidase__InfluenzaA__AJJ99127

SEQ ID NO: 86909 - RNA, 1410 nt, Artificial Sequence; identical to SEQ ID NO: 86581
  derived and/or modified sequence opt1 from neuraminidase__InfluenzaA__AJJ99139

SEQ ID NO: 86910 - RNA, 1410 nt, Artificial Sequence
  derived and/or modified sequence opt1 from neuraminidase__InfluenzaA__AJJ99151
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggagcaacccgaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugcccaucuga

SEQ ID NO: 86911 - RNA, 1410 nt, Artificial Sequence; identical to SEQ ID NO: 77607
  derived and/or modified sequence opt1 from neuraminidase__InfluenzaA__AJJ99163

SEQ ID NO: 86912 - RNA, 1410 nt, Artificial Sequence
  derived and/or modified sequence opt1 from neuraminidase__InfluenzaA__AJJ99175
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggacguacggcaccgggagcuggccggacggcaccgacaucaaccucaugcccaucuga

SEQ ID NO: 86913 - RNA, 1410 nt, Artificial Sequence
  derived and/or modified sequence opt1 from neuraminidase__InfluenzaA__AJJ99199
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 86914 - RNA, 1410 nt, Artificial Sequence; identical to SEQ ID NO: 77751
  derived and/or modified sequence opt1 from neuraminidase__InfluenzaA__AJJ99211

SEQ ID NO: 86915 - RNA, 1410 nt, Artificial Sequence
  derived and/or modified sequence opt1 from neuraminidase__InfluenzaA__AJJ99223
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucugggugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 86916 - RNA, 1410 nt, Artificial Sequence
  derived and/or modified sequence opt1 from neuraminidase__InfluenzaA__AJJ99235
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacgacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccaucgugagcugguccaaggagauccugcgcacccaggagagcgagugcgucugcaucaacggcacgugcaccguggugaugaccgacggguccgccagcggcgaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggagcaacccgaaguccaagcugcagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcucuggaccuccaacagcaucguggucuucugcggcaccuccgggacguacggcaccgggagcuggcccgacggcgccgacaucaaccugaugcccaucuga

SEQ ID NO: 86917 - RNA, 1410 nt, Artificial Sequence
  derived and/or modified sequence opt1 from neuraminidase__InfluenzaA__AJJ99246
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggcgcaacaacauccugcggacgcaggagagcgagugcgcgugccucaacggguccugcuucaccaucaugaccgacggcccgagcgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccagcggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86918 - RNA, 1410 nt, Artificial Sequence
  derived and/or modified sequence opt1 from neuraminidase__InfluenzaA__AJJ99257
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccguccccuccaacggggccaacggcgugaagggguucagcuucaaguacggcaacgggguguggaucggccgcaccaaguccaucagcagccggaagggcuucgagaugaucugggacccgaacggguggaccggcaccgacaacuccuucagcaucaagcaggacaucgucgggacgaacgagugguccggcuacagcggguccuucgugcagcaccccgagcugaccggccuggacugcauccgccccugcuucuggguggagcucauccggggccgccccaaggagaacaccaucuggaccagcggguccagcaucuccuucugcggcgucaacagcgggacggugggcugguccuggccggacggcgccgagcugcccuucaccaucgacaaguga

SEQ ID NO: 86919 - RNA, 1413 nt, Artificial Sequence; identical to SEQ ID NO: 77640
  derived and/or modified sequence opt1 from neuraminidase__InfluenzaA__AJJ99269

SEQ ID NO: 86920 - RNA, 1410 nt, Artificial Sequence; identical to SEQ ID NO: 81966
  derived and/or modified sequence opt1 from neuraminidase__InfluenzaA__AJJ99280

SEQ ID NO: 86921 - RNA, 1410 nt, Artificial Sequence; identical to SEQ ID NO: 81717
  derived and/or modified sequence opt1 from neuraminidase__InfluenzaA__AJJ99291

SEQ ID NO: 86922 - RNA, 1413 nt, Artificial Sequence
  derived and/or modified sequence opt1 from neuraminidase__InfluenzaA__AJJ99303
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcauggagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 86923 - RNA, 1410 nt, Artificial Sequence
  derived and/or modified sequence opt1 from neuraminidase__InfluenzaA__AJJ99314
augaaccccaaccagaagaucaucaccaucggcagcgccugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgcggccggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 86924 - RNA, 1413 nt, Artificial Sequence
  derived and/or modified sequence opt1 from neuraminidase__InfluenzaA__AJJ99326
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggccucggcuggcugaccaucgggaucagcggccccgacaacggggcgguggccguccugaaguacaacggcaucaucacgggcaccaucaaguccuggaagaagcagauccuccgcacccaggagagcgagugcgugugcaugaacggguccugcuucaccaucaugacggacggccccagcaacaaggccgccuccuacaagaucuucaagaucgagaaggggaaggugaccaagagcaucgagcugaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcuccgcaagggguucgagaugaucugggaccccaacggcuggaccaacaccgacagcgacuucuccgugaagcaggacgucguggccaucaccgacuggagcggguacagcggcuccuucgugcagcaccccgagcugacgggccuggacugcauccggcccugcuucugggucgagcucgugcgcgggcugccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 86925 - RNA, 1410 nt, Artificial Sequence; identical to SEQ ID NO: 79390
  derived and/or modified sequence opt1 from neuraminidase__InfluenzaA__AJJ99337

SEQ ID NO: 86926 - RNA, 1410 nt, Artificial Sequence; identical to SEQ ID NO: 78853
  derived and/or modified sequence opt1 from neuraminidase__InfluenzaA__AJJ99348

SEQ ID NO: 86927 - RNA, 1410 nt, Artificial Sequence; identical to SEQ ID NO: 77746
  derived and/or modified sequence opt1 from neuraminidase__InfluenzaA__AJJ99359

SEQ ID NO: 86928 - RNA, 1410 nt, Artificial Sequence
  derived and/or modified sequence opt1 from neuraminidase__InfluenzaA__AJJ99370
augaaccccaaccagaagaucaucaccaucggcagcgugugcaugaucaucgggauggccaaccugauccuccagaucggcaacaucaucuccaucuggaucagccacuccauccagcuggggaaccagagccagaucgagaccugcaaccaguccgucaucacguacgagaacaacaccugggugaaccagaccuacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagcccccaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggcccgagcgaccgccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 86929 - RNA, 1410 nt, Artificial Sequence; identical to SEQ ID NO: 81265
  derived and/or modified sequence opt1 from neuraminidase__InfluenzaA__AJJ99381

SEQ ID NO: 86930 - RNA, 1410 nt, Artificial Sequence
  derived and/or modified sequence opt1 from neuraminidase__InfluenzaA__AJJ99392
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugucccccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccaagcugcccuucacgaucgacaaguga

SEQ ID NO: 86931 - RNA, 1410 nt, Artificial Sequence; identical to SEQ ID NO: 77746
  derived and/or modified sequence opt1 from neuraminidase__InfluenzaA__AJJ99403

SEQ ID NO: 86932 - RNA, 1413 nt, Artificial Sequence; identical to SEQ ID NO: 78469
  derived and/or modified sequence opt1 from neuraminidase__InfluenzaA__AJJ99415

SEQ ID NO: 86933 - RNA, 1413 nt, Artificial Sequence
  derived and/or modified sequence opt1 from neuraminidase__InfluenzaA__AJJ99427
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccguguacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacgggcaccaucaaguccuggaagaagcagauccugcgcacccaggagagcgagugcgugugcaugaacggguccugcuucaccaucaugacggacggccccagcgacaaggccgccuccuacaagaucuucaagaucgagaaggggaaggucaccaagagcaucgagcucaacgcccccaacuucuacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaucaacaccgacagcgacuucuccgucaagcaggacgugguggccaucaccgacuggagcggguacagcggcuccuucguccagcaccccgagcucaccggccuggacugcauccggcccugcuucuggguggagcugguccgcgggcucccgcgggagaacacgaccaucuggaccagcggcuccagcaucuccuucugcggggugaacagcgacaccgccaacugguccuggcccgacggcgccgagcugcccuucacgaucgacaaguga

SEQ ID NO: 86934 - RNA, 1413 nt, Artificial Sequence
  derived and/or modified sequence opt1 from neuraminidase__InfluenzaA__AJJ99439
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaccagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 86935 - RNA, 1413 nt, Artificial Sequence
  derived and/or modified sequence opt1 from neuraminidase__InfluenzaA__AJJ99451
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaaccgcaccgucaaggaccggagccccuaccgcgcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcggacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggguacaucugcagcggcgucuucggcgacaacccccgccccgaggacggggagggcuccugcaacccggugaccguggacggggcgaacggcgucaagggguucagcuacaaguacgacaacggcguguggaucggccggacgaaguccaaccgccugcggaagggguucgagaugaucugggaccccaacggcuggaccaacaccgacagcgacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 86936 - RNA, 1413 nt, Artificial Sequence; identical to SEQ ID NO: 77640
  derived and/or modified sequence opt1 from neuraminidase__InfluenzaA__AJJ99463

SEQ ID NO: 86937 - RNA, 1410 nt, Artificial Sequence
  derived and/or modified sequence opt1 from neuraminidase__InfluenzaA__AJJ99474
augaaccccaaccagaagaucaucaccaucggcagcgugugcaugaccaucgggaucgccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacagcuucuccaucaagcaggacaucguggggaucaacgaguggagcggcuacuccgggagcuucguccagcacccggagcugaccggccuggacugcauccgccccugcuucuggguggagcucauccggggccgccccaaggagaacacgaucuggaccuccgggagcuccaucagcuucugcggcgugaacuccgggaccgucggcuggagcuggcccgacggcgccgagcugccguucaccaucgacaaguga

SEQ ID NO: 86938 - RNA, 1410 nt, Artificial Sequence; identical to SEQ ID NO: 81717
  derived and/or modified sequence opt1 from neuraminidase__InfluenzaA__AJJ99496

SEQ ID NO: 86939 - RNA, 1410 nt, Artificial Sequence
  derived and/or modified sequence opt1 from neuraminidase__InfluenzaA__AJJ99507
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacgacaacggcgucuggaucgggcgcaccaaguccaucagcagccggaacggcuucgagaugaucugggaccccaacggcuggaccgggaccgacaacgacuucuccaucaagcaggacaucgugggcaucaacgaguggagcggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggcggagcugccguucacgaucgacaaguga

SEQ ID NO: 86940 - RNA, 1410 nt, Artificial Sequence; identical to SEQ ID NO: 77746
  derived and/or modified sequence opt1 from neuraminidase__InfluenzaA__AJJ99518

SEQ ID NO: 86941 - RNA, 1410 nt, Artificial Sequence
  derived and/or modified sequence opt1 from neuraminidase__InfluenzaA__AJJ99529
augaaccccaaccagaagaucaucaccaucggcagcgugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacggguucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 86942 - RNA, 1410 nt, Artificial Sequence
  derived and/or modified sequence opt1 from neuraminidase__InfluenzaA__AJJ99540
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcaagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggaucuggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 86943 - RNA, 1410 nt, Artificial Sequence
  derived and/or modified sequence opt1 from neuraminidase__InfluenzaA__AJJ99551
augaaccccaaccagaagaucaucaccaucggcagcgugugcaugaccaucgggauggccaaccugauccuccagaucggcaacaucaucuccaucuggaucagccacuccauccagcuggggaaccagagccagacggagaccugcaaccaguccgucaucaccuacgagaacaacaccugggugaaccagacguacgugaacaucagcaacaccaacccggccgcgggccaguccgucgugagcgugaagcuggccgggaacuccagccucugccccgucuccggcugggccaucuacagcaaggacaacuccauccgcaucggcagcaagggggacguguucgugauccgggagcccuucaucuccugcagcucccuggagugccgcaccuucuuccugacccagggcgcccuccugaacgacaagcacagcaacgggacgaucaaggaccggucccccuaccgcacccugaugagcugcccgaucggcgagguccccagccccuacaacucccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 86944 - RNA, 1410 nt, Artificial Sequence; identical to SEQ ID NO: 81733
  derived and/or modified sequence opt1 from neuraminidase__InfluenzaA__AJJ99562

SEQ ID NO: 86945 - RNA, 1410 nt, Artificial Sequence
  derived and/or modified sequence opt1 from neuraminidase__InfluenzaA__AJJ99573
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacgucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86946 - RNA, 1410 nt, Artificial Sequence; identical to SEQ ID NO: 86923
  derived and/or modified sequence opt1 from neuraminidase__InfluenzaA__AJJ99584

SEQ ID NO: 86947 - RNA, 1410 nt, Artificial Sequence
  derived and/or modified sequence opt1 from neuraminidase__InfluenzaA__AJJ99595
augaaccccaaccagaagaucaucaccaucggcagcgugugcaugaccaucgggauggccaaccugaucuuccagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 86948 - RNA, 1410 nt, Artificial Sequence
  derived and/or modified sequence opt1 from neuraminidase__InfluenzaA__AJJ99606
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86949 - RNA, 1413 nt, Artificial Sequence; identical to SEQ ID NO: 78469
  derived and/or modified sequence opt1 from neuraminidase__InfluenzaA__AJJ99618

SEQ ID NO: 86950 - RNA, 1413 nt, Artificial Sequence
  derived and/or modified sequence opt1 from neuraminidase__InfluenzaA__AJJ99630
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccaugaagcagaacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 86951 - RNA, 1413 nt, Artificial Sequence; identical to SEQ ID NO: 78469
  derived and/or modified sequence opt1 from neuraminidase__InfluenzaA__AJJ99642

SEQ ID NO: 86952 - RNA, 1413 nt, Artificial Sequence; identical to SEQ ID NO: 78469
  derived and/or modified sequence opt1 from neuraminidase__InfluenzaA__AJJ99654

SEQ ID NO: 86953 - RNA, 1413 nt, Artificial Sequence
  derived and/or modified sequence opt1 from neuraminidase__InfluenzaA__AJJ99666
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacaacaacgugguggcgggggaggacaagacgagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuuccacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcaccaaguccaaccggcugcgcaagggcuucgagaugaucugggaccccaacggguggacgaacaccgacagcgacuucuccgugaagcaggacgucguggccaucaccgacuggagcggcuacagcggguccuucgugcagcaccccgagcucaccggccuggacugcauccggcccugcuucugggucgagcuggugcgcggccucccgcgggagaacacgaccaucuggaccagcggguccagcaucuccuucugcggcgucaacagcgacaccgccaacugguccuggcccgacggggccgagcugcccuucacgaucgacaaguga

SEQ ID NO: 86954 - RNA, 1410 nt, Artificial Sequence
  derived and/or modified sequence opt1 from neuraminidase__InfluenzaA__AJJ99677
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacagcuucuccaucaagcaggacaucguggggaugaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgggaccgucggcuggagcuggcccgacggcgccgagcugccguucacgaucgacaaguga

SEQ ID NO: 86955 - RNA, 1410 nt, Artificial Sequence
  derived and/or modified sequence opt1 from neuraminidase__InfluenzaA__AJJ99688
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacagcuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgggaccgucggcuggagcuggcccgacggcgccgagcugccguucacgaucgacaaguga

SEQ ID NO: 86956 - RNA, 1410 nt, Artificial Sequence
  derived and/or modified sequence opt1 from neuraminidase__InfluenzaA__AJJ99710
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccaagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86957 - RNA, 1410 nt, Artificial Sequence; identical to SEQ ID NO: 81265
  derived and/or modified sequence opt1 from neuraminidase__InfluenzaA__AJJ99721

SEQ ID NO: 86958 - RNA, 1410 nt, Artificial Sequence; identical to SEQ ID NO: 81265
  derived and/or modified sequence opt1 from neuraminidase__InfluenzaA__AJJ99732

SEQ ID NO: 86959 - RNA, 1410 nt, Artificial Sequence; identical to SEQ ID NO: 81965
  derived and/or modified sequence opt1 from neuraminidase__InfluenzaA__AJJ99743

SEQ ID NO: 86960 - RNA, 1410 nt, Artificial Sequence; identical to SEQ ID NO: 79299
  derived and/or modified sequence opt1 from neuraminidase__InfluenzaA__AJJ99754

SEQ ID NO: 86961 - RNA, 1410 nt, Artificial Sequence
  derived and/or modified sequence opt1 from neuraminidase__InfluenzaA__AJJ99765
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccaccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 86962 - RNA, 1413 nt, Artificial Sequence
  derived and/or modified sequence opt1 from neuraminidase__InfluenzaA__AJJ99777
augaaccccaaccagaagaucaucaccaucggcagcaucuccaucgccaucgggaucaucagccugauccuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccgccgucuggaccagcggcuccagcaucuccuucugcggggugaacagcgacaccgccaacugguccuggcccgacggcgccgagcugcccuucacgaucgacaaguga

SEQ ID NO: 86963 - RNA, 1410 nt, Artificial Sequence; identical to SEQ ID NO: 77746
  derived and/or modified sequence opt1 from neuraminidase__InfluenzaA__AJJ99788

SEQ ID NO: 86964 - RNA, 1413 nt, Artificial Sequence
  derived and/or modified sequence opt1 from neuraminidase__InfluenzaA__AJJ99800
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaucaucgacaaguga

SEQ ID NO: 86965 - RNA, 1413 nt, Artificial Sequence; identical to SEQ ID NO: 78469
  derived and/or modified sequence opt1 from neuraminidase__InfluenzaA__AJJ99812

SEQ ID NO: 86966 - RNA, 1413 nt, Artificial Sequence
  derived and/or modified sequence opt1 from neuraminidase__InfluenzaA__AJJ99824
augaaccccaaccagaagaucaucaccaucggcagcaucuccaucgccaucgggaccaucagccugaugcuccagaucggcaacaucaucuccaucugggccagccacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacgacaacggcguguggaucgggcgcaccaaguccaaccggcugcgcaagggcuucgagaugaucugggaccccaacggguggaccaacaccgacagcgacuucuccgugaagcaggacgucguggccaucacggacuggagcggcuacagcggguccuucgugcagcaccccgagcucaccggccuggacugcauccggcccugcuucugggucgagcuggugcgcggccucccgcgggagaacaccaccaucuggacgagcggguccagcaucuccuucugcggcgucaacagcgacaccgccaacugguccuggcccgacggggccgagcugcccuucaccaucgacaaguga

SEQ ID NO: 86967 - RNA, 1410 nt, Artificial Sequence; identical to SEQ ID NO: 86955
  derived and/or modified sequence opt1 from neuraminidase__InfluenzaA__AJJ99835

SEQ ID NO: 86968 - RNA, 1410 nt, Artificial Sequence; identical to SEQ ID NO: 81265
  derived and/or modified sequence opt1 from neuraminidase__InfluenzaA__AJJ99846

SEQ ID NO: 86969 - RNA, 1410 nt, Artificial Sequence; identical to SEQ ID NO: 81265
  derived and/or modified sequence opt1 from neuraminidase__InfluenzaA__AJJ99857

SEQ ID NO: 86970 - RNA, 1410 nt, Artificial Sequence
  derived and/or modified sequence opt1 from neuraminidase__InfluenzaA__AJJ99868
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgugaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcagaacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86971 - RNA, 1410 nt, Artificial Sequence; identical to SEQ ID NO: 80165
  derived and/or modified sequence opt1 from neuraminidase__InfluenzaA__AJJ99879

SEQ ID NO: 86972 - RNA, 1410 nt, Artificial Sequence; identical to SEQ ID NO: 77746
  derived and/or modified sequence opt1 from neuraminidase__InfluenzaA__AJJ99890

SEQ ID NO: 86973 - RNA, 1410 nt, Artificial Sequence
  derived and/or modified sequence opt1 from neuraminidase__InfluenzaA__AJJ99901
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucgacuccgggaccgugggcuggagcuggcccgacggcgccgagcugccguucacgaucgacaaguga

SEQ ID NO: 86974 - RNA, 1410 nt, Artificial Sequence
  derived and/or modified sequence opt1 from neuraminidase__InfluenzaA__AJJ99912
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccaagaucacgugcgugugccgggacaacuggcacggcagcaaccgccccuggguguccuucaaccagaaccucgaguaccagaucggguacaucugcagcggcaucuucggggacaacccgcggcccaaggacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 86975 - RNA, 1410 nt, Artificial Sequence; identical to SEQ ID NO: 81265
  derived and/or modified sequence opt1 from neuraminidase__InfluenzaA__AJJ99923

SEQ ID NO: 86976 - RNA, 1410 nt, Artificial Sequence; identical to SEQ ID NO: 81717
  derived and/or modified sequence opt1 from neuraminidase__InfluenzaA__AJJ99934

SEQ ID NO: 86977 - RNA, 1410 nt, Artificial Sequence; identical to SEQ ID NO: 81265
  derived and/or modified sequence opt1 from neuraminidase__InfluenzaA__AJJ99945

SEQ ID NO: 86978 - RNA, 1410 nt, Artificial Sequence
  derived and/or modified sequence opt1 from neuraminidase__InfluenzaA__AJJ99956
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 86979 - RNA, 1410 nt, Artificial Sequence; identical to SEQ ID NO: 77746
  derived and/or modified sequence opt1 from neuraminidase__InfluenzaA__AJJ99967

SEQ ID NO: 86980 - RNA, 1413 nt, Artificial Sequence
  derived and/or modified sequence opt1 from neuraminidase__InfluenzaA__AJJ99991
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacugcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 86981 - RNA, 1410 nt, Artificial Sequence; identical to SEQ ID NO: 86955
  derived and/or modified sequence opt1 from neuraminidase__InfluenzaA__AJK00003

SEQ ID NO: 86982 - RNA, 1410 nt, Artificial Sequence
  derived and/or modified sequence opt1 from neuraminidase__InfluenzaA__AJK00014
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcgugaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccacgaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcaucaucuccuucugcggcgugaacagcgacacggucgggugguccuggcccgacggcgccgagcugccguucaccaucgacaacuga

SEQ ID NO: 86983 - RNA, 1410 nt, Artificial Sequence
  derived and/or modified sequence opt1 from neuraminidase__InfluenzaA__AJK00025
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 86984 - RNA, 1410 nt, Artificial Sequence
  derived and/or modified sequence opt1 from neuraminidase__InfluenzaA__AJK00036
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacaucaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacacgaucuggaccuccgggagcuccaucagcuucugcggcgucaacuccgacaccgugggguggagcuggcccgacggcgccgagcugccguucaccaucgacaaguga

SEQ ID NO: 86985 - RNA, 1410 nt, Artificial Sequence; identical to SEQ ID NO: 81965
  derived and/or modified sequence opt1 from neuraminidase__InfluenzaA__AJK00047

SEQ ID NO: 86986 - RNA, 1410 nt, Artificial Sequence; identical to SEQ ID NO: 81965
  derived and/or modified sequence opt1 from neuraminidase__InfluenzaA__AJK00058

SEQ ID NO: 86987 - RNA, 1410 nt, Artificial Sequence
  derived and/or modified sequence opt1 from neuraminidase__InfluenzaA__AJK00069
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacuucaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 86988 - RNA, 1413 nt, Artificial Sequence; identical to SEQ ID NO: 78469
  derived and/or modified sequence opt1 from neuraminidase__InfluenzaA__AJK00081

SEQ ID NO: 86989 - RNA, 1413 nt, Artificial Sequence; identical to SEQ ID NO: 77640
  derived and/or modified sequence opt1 from neuraminidase__InfluenzaA__AJK00093

SEQ ID NO: 86990 - RNA, 1413 nt, Artificial Sequence
  derived and/or modified sequence opt1 from neuraminidase__InfluenzaA__AJK00105
augagccccaaccagaagaucaucaccaucggcuccaucagcaucgccaucgggaucaucucccugaugcuccagaucggcaacaccaucagcaucugggccucccacagcauccagacggggucccagaacaacaccggcaucugcaaccagcgcaucaucaccuacgagaacagcaccugggugaaccacacguacgucaacaucaacaacaccaacgugguggcgggggaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucacgaucgggaucuccggccccgacaacggggcgguggccguccugaaguacaacggcaucaucaccggcaccaucaagagcuggaagaagcagauccugcgcacccaggaguccgagugcgugugcaugaacgggagcugcuucacgaucaugaccgacggccccuccaacaaggccgccagcuacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugacgguggacggcgcgaacggggucaagggcuucuccuacaaguacgacaacggcguguggaucgggcgcaccaagagcaaccggcugcgcaagggcuucgagaugaucugggaccccaacggguggaccaacaccgacuccgacuucagcgugaagcaggacgucguggccaucacggacuggagcggcuacuccgggagcuucgugcagcaccccgagcucaccggccuggacugcauccggcccugcuucugggucgagcuggugcgcggccucccgcgggagaacaccaccaucuggacguccgggagcuccaucagcuucugcggcgucaacuccgacaccgccaacuggagcuggcccgacggggccgagcugcccuucaccaucgacaaguga

SEQ ID NO: 86991 - RNA, 1410 nt, Artificial Sequence; identical to SEQ ID NO: 80021
  derived and/or modified sequence opt1 from neuraminidase__InfluenzaA__AJK00116

SEQ ID NO: 86992 - RNA, 1410 nt, Artificial Sequence; identical to SEQ ID NO: 78853
  derived and/or modified sequence opt1 from neuraminidase__InfluenzaA__AJK00127

SEQ ID NO: 86993 - RNA, 1410 nt, Artificial Sequence; identical to SEQ ID NO: 77746
  derived and/or modified sequence opt1 from neuraminidase__InfluenzaA__AJK00138

SEQ ID NO: 86994 - RNA, 1350 nt, Artificial Sequence
  derived and/or modified sequence opt1 from neuraminidase__InfluenzaA__AJK00152
augaaccccaaccagaagaucaucaccaucggcagcaucugcauggugaccgggaucgucucccugaugcuccagaucggcaacaucaucagcaugugggugucccacagcauccagacgcgcaaccagcaccagaccgagccgauccggaacaccaacuuccugaccgagaacgccguggccuccgucacgcuggcggggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccucaucaacgacaagcacuccaacgggaccgugaaggaccgcagcccccaccggacgcugauguccugcccggugggcgaggcccccagccccuacaacucccgcuucgagagcgucgccugguccgcgagcgccugccacgacgggaccagcuggcugaccaucggcaucuccgggcccgacaacggcgccguggccgugcucaaguacaacggcaucaucaccgacacgaucaagagcuggcggaacaacauccugcgcacccaggaguccgagugcgcgugcgucaacgggagcugcuucaccgugaugaccgacggcccguccaacgggcaggccagcuacaagaucuucaagauggagaagggcaagguggucaaguccguggagcugaacgcccccaacuaccacuacgaggagugcagcugcuaccccgacgccggcgagaucacgugcgugugccgggacaacuggcacggguccaaccgccccugggucagcuucaaccagaaccucgaguaccagaucggcuacaucugcuccgggguguucggcgacaacccgcggcccaacgacgggaccggcagcugcggccccgugucccccaacggggccuacggcaucaagggguucagcuucaaguacggcaacggggucuggaucggccgcaccaaguccaccaacagccgguccggcuucgagaugaucugggacccgaacggguggacgggcaccgacagcgacuucuccgugaagcaggacaucguggagaucaccgacuggagcggguacagcggcuccuucguccagcaccccgagcugaccgggcuggacugcauccgccccugcuucuggguggagcucauccggggccgccccaaggagagcacgaucuggaccuccggcagcuccaucagcuucugcggggucaacuccgacaccgugagcugguccuggccggacggcgcggagcugcccuucaccaucgacaaguga

SEQ ID NO: 86995 - RNA, 1350 nt, Artificial Sequence
  derived and/or modified sequence opt1 from neuraminidase__InfluenzaA__AJK00167
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacgccaacuuccugacggagaacgcgguggccuccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacccagggggcccuccugaacgacaagcacuccaacggcacggugaaggaccggagcccccaccgcacccugauguccugcccggucggggaggcgcccagccccuacaacucccgguucgagagcguggccugguccgccagcgccugccacgacggcaccagcuggcucaccaucgggaucuccggccccgacaacggcgcgguggccguccugaaguacaacgggaucaucacggacaccaucaagagcuggcgcaacaacauccugcggacccaggaguccgagugcgccugcgugaacggcagcugcuucaccgugaugacggacgggccguccaacggccaggccagcuacaagaucuucaagauggagaagggcaaggucgugaaguccguggagcucaacgcccccaacuaccacuacgaggagugcagcugcuaccccgacgcgggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgccuacgggaucaagggcuucagcuucaaguacgggaacggcguguggaucggccggaccaaguccaccaacagccgcuccggguucgagaugaucugggacccgaacggcuggaccgagaccgacagcaacuucuccgugaagcaggacaucgucgccaucaccgacuggagcggguacagcggcuccuucgugcagcaccccgagcugacggggcucgacugcauccggcccugcuucugggucgagcugauccgcggccggcccaaggagagcaccaucuggaccuccggcagcuccaucagcuucugcggggugaacuccgacaccgugagcugguccuggccggacggcgccgagcugcccuucacgaucgacaaguga

SEQ ID NO: 86996 - RNA, 1350 nt, Artificial Sequence
  derived and/or modified sequence opt1 from neuraminidase__InfluenzaA__AJK00178
augaaccccaaccagaagaucaucaccaucggcagcaucugcauggugaucgggaucgucucccugaugcuccagaucggcaacaugaucagcaucugggccucccacagcauccgcaccgggaaccagaaccagguggagccgaucaucaacacgaacuuccccaccgagaaggccgcggccuccaucacccuggccggcaacagcucccugugccccauccgggggugggccauccacagcaaggacaacuccauccgcaucggcagcaagggcgacguguucgucauccgggagcccuucaucuccugcagccaccucgagugccgcaccuucuuccugacgcagggggcccugcucaacgacaagcacuccaacggcaccgugaaggaccggagcccgcaccgcacccugauguccugccccgugggggaggcgcccagccccuacaacucccgguucgagagcgucgccugguccgccagcgccugccacgacggcaccagcuggcugacgaucgggaucuccggcccggacaacggcgcgguggccgugcucaaguacaacgggaucaucaccgacaccaucaagaccuggcgcaacaacauccugcggacgcaggagagcgagugcgccugcgucaacggcuccugcuucaccgugaugaccgacgggcccagcgacggccaggccuccuacaagaucuucaagauggagaagggcaaggugaucaagagcgucgagcuggacgcccccaacuaccacuacgaggagugcuccugcuaccccgacgcgggggagaucacgugcgugugccgcgacaacuggcacggcagcaaccggccguggguguccuucaaccagaaccucgaguaccagaucggguacaucugcagcggcgucuucggggacaacccccgccccaccgacggcaccggcuccugcgggcccgugagccacaacggcgccuacggggugaagggcuucuccuucaaguacgggaacggcgucuggaucggccggaccaagagcccgaacucccgcagcggguucgagaugaucugggaccccaacggcugguccgagaccgacagcuccuucagcgugaagcaggacaucguggccaucacggacuggagcggguacuccggcagcuucguccagcaccccgagcugaccgggcuggacugcauccggcccugcuucuggguggagcucauccgcggccggccgaaggaguccaccguguggaccagcggcuccagcaucuccuucugcggggucaacagcgacacgguguccuggagcuggcccgacggcgccgagcugcccuucaccaucgacaaguga

SEQ ID NO: 86997 - RNA, 1350 nt, Artificial Sequence
  derived and/or modified sequence opt1 from neuraminidase__InfluenzaA__AJK00199
augaaccccaaccagaagaucaucaccaucggcagcaucugcauggugaucgggaucgucucccugaugcuccagaucggcaacaugaucagcaucugggugucccacagcauccagaccgggaaccagaaccagguggagccgaucaucaacacgaacuuccugaccgagaaggccgucguguccaucacccuggccggcaacagcucccucugccccauccgcgggugggcgauccacagcaaggacaacuccauccggaucggcagcaagggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgccugguccgccagcgcgugccacgacggcaccagcuggcucacgaucgggaucuccggccccgacaacggcgccgccgccgugcugaaguacaacgggaucaucaccgacaccaucaagagcuggcggaacaacauccugcgcacccaggaguccgagugcgcgugcgugaacggcagcugcuucacggucaugaccgacgggccguccgacggccaggccagcuacaagaucuucaagauggagaagggcaaggugaucaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcucccccgucagccacaacggggccuacggcgugaagggguucuccuucaaguacggcaacgggguguggaucggccgcaccaagagccccaacucccggagcggcuucgagaugaucugggacccgaacgggugguccgagaccgacagcagcuucuccgucaagcaggacaucguggcgaucaccgacuggagcggcuacuccgggagcuucgugcagcaccccgagcugaccggccucgacugcauccgccccugcuucugggucgagcugauccgggggcgccccaaggaguccacgguguggaccagcggcuccagcaucuccuucugcggcgucaacagcgacaccguguccuggagcuggccggacggggccgagcugcccuucaccaucgacaaguga

SEQ ID NO: 86998 - RNA, 1350 nt, Artificial Sequence
  derived and/or modified sequence opt1 from neuraminidase__InfluenzaA__AJK00208
augaaccccaaccagaagaucaucaccaucggcagcaucugcauggugaccgggaucgucucccugaugcuccagaucggcaacaucaucagcaugugggugucccacagcauccagacgcgcaaccagcaccagaccgagccgauccggaacaccaacuuccugaccgagaacgccguggccuccgucacgcuggcggggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccuccugaacgacaagcacuccaacgggaccgugaaggaccgcagcccccaccggacgcugauguccugcccggugggcgaggcccccagccccuacaacucccgcuucgagagcgucgccugguccgcgagcgccugccacgacgggaccagcuggcucaccaucggcaucuccgggcccgacaacggcgccguggccgugcugaaguacaacggcaucaucaccgacacgaucaagagcuggcggaacaacauccugcgcacccaggaguccgagugcgcgugcgucaacgggagcugcuucaccgugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggacgggcagcugcggccccgugucccccaacggggccuacggcaucaagggguucagcuucaaguacggcaacggggucuggaucggccgcaccaaguccaccaacagccgguccggcuucgagaugaucugggacccgaacggguggaccggcacggacagcgacuucuccgugaagcaggacaucguggagaucaccgacuggagcggguacagcggcuccuucguccagcaccccgagcugaccgggcucgacugcauccgccccugcuucuggguggagcugauccggggccgccccaaggagagcaccaucuggacguccggcagcuccaucagcuucugcggggucaacuccgacaccgugagcugguccuggccggacggcgcggagcugcccuucaccaucgacaaguga

SEQ ID NO: 86999 - RNA, 1350 nt, Artificial Sequence
  derived and/or modified sequence opt1 from neuraminidase__InfluenzaA__AJK00219
augaaccccaaccagaagaucaucaccaucggcagcaucugcauggugaccgggaucgucucccugaugcuccagaucggcaacaucaucagcaugugggugucccacagcauccagacgcgcaaccagcaccaggccgagccgauccggaacaccaacuuccugaccgagaacgccguggcguccgucacccuggccgggaaccucagccugugccccauccgcggcugggccgugcacuccaaggacaacaacauccggaucgggagcaagggcgacguguucgucauccgcgagcccuucaucuccugcagccaccuggagugccggacguucuuccucacccagggcgcccugcugaacgacaagcacuccaacgggaccgugaaggaccgcagcccccaccggacccucauguccugcccggugggcgaggcccccagccccuacaacucccgcuucgagagcgucgcgugguccgccagcgccugccacgacgggacguccuggcugaccaucggcaucagcgggcccgacaacggcgccguggcggugcugaaguacaacggcaucaucaccgacaccaucaagagcuggcggaacaacauccuccgcacgcaggaguccgagugcgccugcgucaacgggagcugcuucaccgugaugaccgacggcccguccaacgggcaggccagcuacaagaucuucaagauggagaagggcaagguggucaaguccguggagcugaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccgugucccccaacggggcguacggcaucaagggguucagcuucaaguacggcaacggggucuggaucggccgcacgaaguccaccaacagccgguccggcuucgagaugaucugggacccgaacggguggaccggcaccgacagcgacuucuccgugaagcaggacaucguggagaucacggacuggagcggguacuccggcagcuucguccagcaccccgagcucaccgggcuggacugcauccgccccugcuucuggguggagcugauccggggccgccccaaggagagcaccaucuggaccuccggcagcuccaucagcuucugcggggucaacuccgacacggugagcugguccuggccggacggcgccgagcuccccuucaccaucgacaaguga

SEQ ID NO: 87000 - RNA, 1350 nt, Artificial Sequence
  derived and/or modified sequence opt1 from neuraminidase__InfluenzaA__AJK00230
augaaccccaaccagaagaucaucaccaucggcagcaucugcauggugaccgggaucgucucccugaugcuccagaucggcaacaucaucagcaugugggugucccacagcauccagacgcgcaaccagcaccagaccgagccgauccggaacaccaacuuccugaccgagaacgccguggccuccgucacgcuggcggggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccucaucaacgacaagcacuccaacgggaccgugaaggaccgcagcccccaccggacgcugauguccugcccggugggcgaggcccccagccccuacaacucccgcuucgagagcgucgccugguccgcgagcgccugccacgacgggaccagcuggcugaccaucggcaucuccgggcccgacaacggcgccguggccgugcucaaguacaacggcaucaucaccgacacgaucaagagcuggcggaacaacauccugcgcacccaggaguccgagugcgcgugcgucaacgggagcugcuucaccgugaugaccgacggcccguccaacgggcaggccagcuacaagaucuucaagauggagaagggcaagguggucaaguccguggagcugaacgcccccaacuaccacuacgaggagugcagcugcuaccccgacgccggcgagaucaucugcgugugccgggacaacuggcacggguccaaccgccccugggucagcuucaaccagaaccucgaguaccagaucggcuacaucugcuccgggguguucggcgacaacccgcggcccaacgacgggacgggcagcugcggccccgugucccccaacggggccuacggcaucaagggguucagcuucaaguacggcaacggggucuggaucggccgcaccaaguccaccaacagccgguccggcuucgagaugaucugggacccgaacggguggaccggcacggacagcgacuucuccgugaagcaggacaucguggagaucaccgacuggagcggguacagcggcuccuucguccagcaccccgagcugaccgggcuggacugcauccgccccugcuucuggguggagcucauccggggccgccccaaggagagcaccaucuggacguccggcagcuccaucagcuucugcggggucaacuccgacaccgugagcugguccuggccggacggcgcggagcugcccuucaccaucgacaaguga

SEQ ID NO: 87001 - RNA, 1380 nt, Artificial Sequence
  derived and/or modified sequence opt1 from neuraminidase__InfluenzaA__AJS18470
augaaccccaaccagaagaucacgugcaucagcgccaccggcgugacccuguccgucgugagccuccugaucgggaucgccaaccugggccucaacaucgggcugcacuacaagguggacgacuccaccaccaucaacaucccgaacaugaacgagaccaaccccacgaucaccaacaucaccaacaucaucgucaacaagaacgaggagcgcaccuuccugaaccucacgaagccccugugcgaggugaacagcuggcacauccuguccaaggacaacgcgauccggaucggcgaggacgcccacauccucgugacccgcgagcccuaccugagcugcgacccgcaggggugccggauguucgcccugucccagggcaccacccuccgcggccggcacgccaacgggacgauccacgaccgcagccccuuccgggcccugaucuccugggagaugggccaggcgcccagccccuacaacacccgcgucgagugcaucgggugguccagcaccuccugccacgacggcaucagccggauguccaucugcaucagcgggccgaacaacaacgccuccgccguggugugguaccgcggccggcccgucaccgagauccccagcugggugggcaacauccugcgcacgcaggaguccgagugcgugugccacaaggggaucugccccgucgugaugaccgacggcccggccaacaacaaggcggccaccaagaucaucuacuucaaggaggggaagauccagaagaucgaggagcuccagggcaacgcccagcacguggaggagugcagcugcuacggcgccgccgggaugaucaagugcgucugccgggacaacuggaagggcgcgaaccgccccaucaucaccaucgaccccgagaugaugacgcacaccagcaaguaccugugcuccaagauccugaccgacaccagccggcccaacgacccgacgaacgggaacugcgacgcccccaucaucggcgggucccccgaccccggcgugaagggcuucgccuaccucgacggggagaacagcuggcugggccgcaccaucuccaaggacagccgguccggguacgagaugcugaaggugccgaacgccgagaccgacacccagagcggccccacguccuaccagcucaucgucaacaaccagaacuggagcggguacuccggcgccuucaucgacuacugggcgaacaagggcugcuucaaccccugcuucuacguggagcugauccgcgggcggcccaaggagaucgacgugcuguggaccagcaacuccauggucgcccucugcggcagccgcgagcggcugggguccuggagcuggcacgacggcgccgagaucaucuacuucaaguga

SEQ ID NO: 87002 - RNA, 1380 nt, Artificial Sequence
  derived and/or modified sequence opt1 from neuraminidase__InfluenzaA__AJS18481
augaaccccaaccagaagaucacgugcaucagcgccaccggcgugacccuguccgucgugagccuccugaucgggaucgccaaccugggccucaacaucgggcugcacuacaagguguccgacagcaccaccaucaacuccccgaacaugaacgagaccaaccccacgaccaccaacaucaccaacaucaucgucaacaagaacgaggagcgcacguuccugaaccucaccaagccccugugcgaggugaacagcuggcacauccuguccaaggacaacgcgauccggaucggcgaggaggcccacauccucgugacccgcgagcccuaccugagcugcgacccgcaggggugccggauguucgcccugucccagggcaccacgcuccgcggccggcacgccaacgggaccauccacgaccgcagccccuuccgggcccugaucuccugggagaugggccaggcgcccagccccuacaacacccgcgucgagugcaucgggugguccagcaccuccugccacgacggcaucagccggauguccaucugcaucagcgggccgaacaacaacgccuccgccguggugugguaccgcggccggcccgucacggagauccccagcugggccggcaacauccugcgcacccaggagagcgagugcgugugccacaaggggaucugccccguggucaugaccgacggcccggcgaacaacaaggccgccaccaagaucaucuacuuccgggaggggaagauccagaagaucgaggagcuccagggcaacgcccagcacaucgaggagugcuccugcuacggcgccgcggggaugaucaagugcgccugccgcgacaacuggaagggcgccaaccggcccaucaucacgaucgaccccgagaugaugacccacaccagcaaguaccugugcuccaagauccugaccgacacgagccgccccaacgacccgaccaacgggaacugcgacgcccccgugaccggcgggucccccgaccccggcaucaagggcuucgccuuccucgacggggagaacagcuggcugggccggaccaucuccaagaacagccgcuccggguacgagaugcugaaggugccgaacgcggagacggacacccagagcggccccaccuccuaccagcucaucgucaacaaccagaacuggagcggguacuccggcgccuucaucgacuacugggccaacaaggagugcuucaaccccugcuucuacguggagcugauccggggccgccccaaggagagcgacgugcuguggaccuccaacagcauggucgcccucugcgggucccgggagcgccugggcagcugguccuggcacgacggggccgagaucaucuacuucaaguga

SEQ ID NO: 87003 - RNA, 1410 nt, Artificial Sequence
  derived and/or modified sequence opt1 from neuraminidase__InfluenzaA__AKA59350
augaaccccaaccagaagaucaucaccaucggcagcgugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccgacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgugugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccguguggaccagcggguccagcaucuccuucugcggcgugaacagcgacaccgucgggugguccuggcccgacggcgccgagcugccguucacgaucgacaaguga

SEQ ID NO: 87004 - RNA, 1410 nt, Artificial Sequence
  derived and/or modified sequence opt1 from neuraminidase__InfluenzaA__AKA59352
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgucggccagagcgugguguccaccaagcucgcggggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgccagcgcgugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 87005 - RNA, 1410 nt, Artificial Sequence
  derived and/or modified sequence opt1 from neuraminidase__InfluenzaA__AKA59354
augaaccccaaccagaagaucaucaccaucggcagcgugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggccaaccagaccuacgugaacaucuccaacacgaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgugugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccgagaccgacaacaacuucagcaucaagcaggacaucgugggcaucaacgagugguccggguacagcggcuccuucguccagcacccggagcugacggggcuggacugcauccgccccugcuucuggguggagcucauccggggccgccccaaggagaacaccgucuggaccagcggcuccagcaucuccuucugcggggugaacagcgacaccgugggcugguccuggcccgacggggccgagcugccguucacgaucgacaaguga

SEQ ID NO: 87006 - RNA, 1380 nt, Artificial Sequence
  derived and/or modified sequence opt1 from neuraminidase__InfluenzaA__AKS48026
augaaccccaaccagaagaucacgugcaucagcgccaccggcgugacccuguccgucgugagccuccugaucgggaucgccaaccugggccucaacaucgggcugcacuacaagguguccgacagcaccaccaucaacaucccgaacaugaacgagaccaaccccacgaccaccaacaucaccaacaucaucgucaacaagaacgaggagcgcacguuccugaaccucaccaagccccugugcgaggugaacuccuggcacauccugagcaaggacaacgcgauccggaucggcgaggacgcccacauccucgugacccgcgagcccuaccuguccugcgacccgcaggggugccggauguucgcccugagccagggcaccacgcuccgcggccggcacgccaacgggaccauccacgacaagucccccuuccgcgcccugaucagcugggagaugggccaggcgcccucccccuacaacacccgggucgagugcaucggguggagcuccaccagcugccacgacggcaucucccgcaugagcaucugcaucuccgggccgaacaacaacgccagcgccguggugugguaccggggccgccccgucacggagauccccuccugggugggcaacauccugcggacccaggagagcgagugcgugugccacaaggggaucugccccgucgugaugaccgacggcccggccaacaacaaggcggccaccaagaucaucuacuucaaggaggggaagauccagaagaucgaggagcuccagggcaacgcccagcacaucgaggagugcagcugcuacggcgccgccgggaugaucaagugcgugugccgcgacaacuggaagggcgcgaaccggcccaucaucacgaucgaccccgagaugaugacccacaccuccaaguaccugugcagcaagauccugaccgacacgucccgccccaacgacccgaccaacgggaacugcgacgagcccaucaccggcgggagccccgaccccggcgucaagggcuucgccuuccucgacggggagaacuccuggcugggccggaccaucagcaaggacucccgcagcggguacgagaugcugaaggugccgaacgccgagacggacacccaguccggccccaccagcuaccagcucaucgugaacaaccagaacugguccggguacagcggcgccuucaucgacuacugggccaacaaggagugcuucaaccccugcuucuacgucgagcugauccggggccgccccaaggagaucgacgugcugugggcguccaacagcaugguggcccucugcgggucccgggagcgccugggcagcugguccuggcacgacggggccgagaucaucuacuucaaguga

SEQ ID NO: 87007 - RNA, 1380 nt, Artificial Sequence
  derived and/or modified sequence opt1 from neuraminidase__InfluenzaA__AKS48040
augaaccccaaccagaagaucacgugcaucagcgccaccggcaugacccuguccguggucagccuccugaucgggaucgccaaccugggccucaacaucgggcugcacuacaagguguccgacagcaccaccaucaacaucccgaacaugaacgagaccaaccccacgaccaccaacaucaccaacaucaucgugaacaagaacgaggagcgcacguuccugaaccucaccaagccccugugcgaggucaacuccuggcacauccugagcaaggacaacgcgauccggaucggcgaggacgcccacauccucgugacccgcgagcccuaccuguccugcgacccgcaggggugccggauguucgcccugagccagggcaccacgcuccgcggccggcacgccaacgggaccauccacgaccgcucccccuuccgggcccugaucagcugggagaugggccaggcgcccucccccuacaacacccgcguggagugcaucggguggagcuccaccagcugccacgacggcaucucccggaugagcaucugcaucuccgggccgaacaacaacgccagcgccgucgugugguaccgcggccggcccgugacggagauccccuccugggucggcaacauccugcgcacccaggagagcgagugcgugugccacaaggggaucugccccguggucaugaccgacggcccggccaacaacaaggcggccaccaagaucaucuacuucaaggaggggaagauccagaagaucgaggagcuccagggcaacgcccagcacaucgaggagugcagcugcuacggcgccgccgggaugaucaagugcgugugccgggacaacuggaagggcgcgaaccgccccaucaucacgaucgaccccgagaugaugacccacaccuccaaguaccugugcagcaagauccugaccgacacgucccggcccaacgacccgaccaacgggaacugcgacgcccccaucaccggcgggagccccgaccccggcgugaagggcuucgccuuccucgacggggagaacuccuggcugggccgcaccaucagcaaggacucccggagcggguacgagaugcugaaggucccgaacgccgagacggacacccaguccggccccaccagcuaccagcucaucgugaacaaccagaacugguccggguacagcggcgccuucaucgacuacugggcgaacaaggagugcuucaaccccugcuucuacguggagcugauccgcggccggcccaaggagaucgacguccugugggccuccaacagcaugguggcccucugcgggucccgcgagcggcugggcagcugguccuggcacgacggggccgagaucaucuacuucaaguga

SEQ ID NO: 87008 - RNA, 1380 nt, Artificial Sequence
  derived and/or modified sequence opt1 from neuraminidase__InfluenzaA__ALO75898
augaaccccaaccagaagaucacgugcaucagcgccaccggcgugacccuguccgucgugagccuccugaucgggaucgccaaccugggccucaacaucgggcugcacuacaagguguccgacagcaccaccaucaacaucccgaacaugaacgagaccaaccccacgaccaccaacaucaccaacaucaucgucaacaagaacgaggagcgcacguuccugaaccucaccaagccccugugcgaggugaacuccuggcacauccugagcaaggacaacgcgauccggaucggcgaggacgcccacauccucgugacccgcgagcccuaccuguccugcgacccgcaggggugccggauguucgcccugagccagggcaccacgcuccgcggccggcacgccaacgggaccauccacgaccgcucccccuuccgggcccugaucagcugggagaugggccaggcgcccucccccuacaacacccgcgucgagugcaucggguggagcuccaccagcugccacgacggcaucucccggaugagcaucugcaucuccgggccgaacaacaacgccagcgccguggugugguaccgcggccggcccgucacggagauccccuccugggugggcaacauccugcgcacccaggagagcgagugcgugugccacaaggggaucugccccgucgugaugaccgacggcccggccaacaacaaggcggccaccaagaucaucuacuucaaggaggggaagauccagaagaucgaggagcuccagggcaacgcccagcacaucgaggagugcagcugcuacggcgccgccgggaugaucaagugcgugugccgggacaacuggaagggcgcgaaccgccccaucaucacgaucgaccccgagaugaugacccacaccuccaaguaccugugcagcaagauccugaccgacacgucccggcccaacgacccgaccaacgggaacugcgacgcccccaucaccggcgggagccccgaccccggcgucaagggcuucgccuuccucgacggggagaacuccuggcugggccgcaccaucagcaaggacucccggagcggguacgagaugcugaaggugccgaacgccgagacggacacccaguccggccccaccagcuaccagcucaucgugaacaaccagaacugguccggguacagcggcgccuucaucgacuacugggcgaacaaggagugcuucaaccccugcuucuacgucgagcugauccgcggccggcccaaggagaucgacgugcugugggccuccaacagcaugguggcccucugcgggucccgcgagcggcugggcagcugguccuggcacgacggggccgagaucaucuacuucaaguga

SEQ ID NO: 87009 - RNA, 1380 nt, Artificial Sequence; identical to SEQ ID NO: 87008
  derived and/or modified sequence opt1 from neuraminidase__InfluenzaA__ALO75910

SEQ ID NO: 87010 - RNA, 1380 nt, Artificial Sequence
  derived and/or modified sequence opt1 from neuraminidase__InfluenzaA__ALO75922
augaaccccaaccagaagaucacgugcaucagcgccaccggcgugacccuguccgucgugagccuccugaucgggaucgccaaccugggccucaacaucgggcugcacuacaagguguccgacagcaccaccaucaacaucccgaacaugaacgagaccaaccccacgaccaccaacaucaccaacaucaucgucaacaagaacgaggagcgcacguuccugaaccucaccaagccccugugcgaggugaacuccuggcacauccugagcaaggacaacgcgauccggaucggcgaggacgcccacauccucgugacccgcgagcccuaccuguccugcgacccgcaggggugccggauguucgcccugagccagggcaccacgcuccgcggccggcacgccaacgggaccauccacgaccgcucccccuuccgggcccugaucagcugggagaugggccaggcgcccucccccuacaacacccgcgucgagugcaucggguggagcuccaccagcugccacgacggcaucucccggaugagcaucugcaucuccgggccgaacaacaacgccagcgccguggugugguaccgcggccggcccgucacggagauccccuccugggugggcaacauccugcgcacccaggagagcgagugcgugugccacaaggggaucugccccgucgugaugaccgacggcccggccaacaacaaggcggccaccaagaucaucuacuucaaggaggggaagauccagaagaucgaggagcuccagggcaacgcccagcacaucgaggagugcagcugcuacggcgccgccgggaugaucaagugcgugugccgggacaacuggaagggcgcgaaccgccccaucaucacgaucgaccccgagaugaugacccacaccuccaaguaccugugcagcaagauccugaccgacacgucccggcccaacgacccgaccaacgggaacugcgacgagcccaucaccggcgggagccccgaccccggcgucaagggcuucgccuuccucgacggggagaacuccuggcugggccgcaccaucagcaaggacucccggagcggguacgagaugcugaaggugccgaacgccgagacggacacccaguccggccccaccagcuaccagcucaucgugaacaaccagaacugguccggguacagcggcgccuucaucgacuacugggccaacaaggagugcuucaaccccugcuucuacgucgagcugauccgcggccggcccaaggagaucgacgugcugugggcguccaacagcaugguggcccucugcgggucccgcgagcggcugggcagcugguccuggcacgacggggccgagaucaucuacuucaaguga

SEQ ID NO: 87011 - RNA, 1401 nt, Artificial Sequence
  derived and/or modified sequence opt1 from neuraminidase__InfluenzaA__ALT20083
augaaccccaaccagcgcaucaccgccaucggcagcgugucccugaucaucgccaucaucugccuccugaugcagaucgcgauccugaccacgaccaugacccuccacuuccggcagaacgagugcagcaacccguccaacaaccaggucaugcccugcgagcccaucaucaucgagcgcaacaccgugcaccugaacagcacgaccaucgagcgggagaucugccccaagguggccgaguacaagaacugguccaagccgcagugccagaucaccggguucgcccccuucagcaaggacaacuccauccgccugagcgccuccggcgacaucugggucacccgggagcccuacgugagcugcucccucaacaagugcuaccaguucgcccuggggcagggcacgacccugaagaacaagcacagcaacgggaccacccacgaccgcacgccccaccggacccuccugaugaacgagcugggcgugccguuccaccucggcaccaagcaggucugcaucgcgugguccagcuccagcugcuacgacgggaaggccuggcugcacgugugcgugaccggcgacgacaagaacgccacggccuccaucaucuacgacgggaugcuggucgacagcaucggcuccuggagcaagaacauccuccgcacccaggagagcgagugcgugugcaucaacgggaccugcgcgguggucaugaccgacggcuccgccagcggcaaggccgacacgcgggugcuguucauccgcgaggggaagaucaucaacaucagcccccuguccggcuccgcccagcacguggaggagugcagcugcuacccccgguaccccgagguccgcugcgugugccgggacaacuggaagggguccaaccgcccgauccucuacaucaacauggccgacuacagcaucgaguccagcuacgugugcuccggccuggucggcgacacgccccggaacgacgacagcuccagcuccagcaacugccgcgaccccaacaacgagcgcggggcgcccggcgugaaggggugggccuucgacgacggcaacgacguguggauggggcggaccaucaagaacggcucccggagcggcuacgagaccuuccgcgucgugaacggguggaccauggccaacuccaagagccagaucaaccgccaggugaucgucgacagcaacgacugguccggcuacagcgggaucuucuccguggagggcaagaagugcaucaaccggugcuucuacgucgagcugauccgcgggcggccgcaggagccccgcgugugguggaccagcaacuccaucaucguguucugcggcaccagcggcaccuacgggacgggcuccuggcccgacggggccaacaucaacuucaugcccaucuga

SEQ ID NO: 87012 - RNA, 1410 nt, Artificial Sequence
  derived and/or modified sequence opt1 from neuraminidase__InfluenzaA__AMA65392
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagccgcggggacgucuucgugauccgggagcccuucaucuccugcagcccccucgagugccggaccuucuuccugacccagggcgcccugcucaacgacaagcacuccaacgggaccaucaaggaccgcagccccuaccggacgcugauguccugcccgaucggcgaggugcccagccccuacaacagccgcuucgaguccgucgccuggagcgcguccgccugccacgacgggaucaacuggcugaccaucggcaucagcggccccgacuccggggccguggccgugcucaaguacaacggcaucaucaccgacaccaucaagagcuggcggaacaacauccugcgcacgcaggaguccgagugcgcgugcgucaacgggagcugcuucaccaucaugaccgacggcccguccgacggccaggccagcuacaagaucuuccggaucgagaaggggaagaucaucaaguccguggagaugaaggcccccaacuaccacuacgaggagugcagcugcuaccccgacuccagcgagaucacgugcgugugccgcgacaacuggcacggcuccaaccggcccugggucagcuucaaccagaaccuggaguaccagaugggguacaucugcuccggcguguucggggacaacccgcgccccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccggcccugcuucuggguggagcugauccgcggccggcccgaggagaacaccaucuggaccagcggguccagcaucuccuucugcggcgucaacagcgacaccguggggugguccuggcccgacggcgccgagcucccguucacgaucgacaaguga

SEQ ID NO: 87013 - RNA, 1410 nt, Artificial Sequence
  derived and/or modified sequence opt1 from neuraminidase__InfluenzaA__AMA65394
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucaucaaguccguggagaugaaggcccccaacuaccacuacgaggagugcagcugcuaccccgacuccagcgagaucacgugcgugugccgggacaacuggcacggcuccaaccgccccugggucagcuucaaccagaaccuggaguaccagaugggguacaucugcuccggcguguucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucguccagcacccggagcucacgggccuggacugcauccgccccugcuucuggguggagcugauccggggccgccccgaggagaacaccaucuggaccagcggguccagcaucuccuucugcggcgucaacagcgacaccguggggugguccuggcccgacggcgccgagcucccguucacgaucgacaaguga

SEQ ID NO: 87014 - RNA, 1410 nt, Artificial Sequence
  derived and/or modified sequence opt1 from neuraminidase__InfluenzaA__BAA00618
augaaccccaaccagaagaucaucaccaugggcagcguguccaucaucaucgccaucgucugccugcucaugcagaucgccauccuggugaccacggugacccugcacuuccgccagcacgagagcgacuccccgcccagcaaccaggucauccccugcgagcccaucaucaucgagcggaacaucaccgagaucguguaccucaacaacaccacgaucgagaaggagaccugcccgaaguccguggaguaccgcaacuggagcaagccccagugcaagaucaccggguucgcgcccuucuccaaggacaacagcauccggcuguccgccggcggggacaucugggucacccgcgagcccuacgugagcugcgacccgggcaagugcuaccaguucgcccuggggcagggcacgacccucgacaacaagcacuccaacgacaccauccacgaccggaucccccaccgcacccugcugaugaacgagcucggcgugcccuuccaccuggggacgcggcaggucugcaucgccuggagcuccagcuccugccacgacggcaaggccuggcugcacgugugcgugaccggggacgacaagaacgcgaccgccagcuucaucuacaacggccgccucgucgacuccaucgggagcuggucccagaacauccugcggacccaggagagcgagugcgugugcaucaacggcacgugcaccguggucaugaccgacggcagcgccuccgggcgcgccgacacccggauccuguucaucgaggagggcaagaucgugcacaucagcccccucuccgggagcgcgcagcacguggaggagugcuccugcuacccgcgcuaccccgacguccggugcaucugccgcgacaacuggaagggcagcaacucccccgugguggacaucaacaugaaggacuacagcaucgacuccagcuacgucugcuccggccuggugggggacacgccccggaacgacgaccgcagcuccaagagcaacugccggaacccgaacaacgagcgcggcaaccacggggugaagggcugggccuucgacaacggggacgacgucuggaugggccggaccaucuccaaggaccugcgcagcggcuacgagaccuucaaggugaucgggggcugguccacccccaacagcaagucccagacgaaccggcaggucaucguggacagcaacaacuggagcggguacuccggcaucuucagcguggaggggaaguccugcaucaaccgcugcuucuacgucgagcucauccgcggccggaagcaggagacccgcgugugguggaccagcaacuccaucguggucuucugcggcaccagcgggacguacggcaccggguccuggcccgacggcgccaacaucgacuucaugcccaucuga

SEQ ID NO: 87015 - RNA, 1410 nt, Artificial Sequence
  derived and/or modified sequence opt1 from neuraminidase__InfluenzaA__BAA00619
augaaccccaaccagaagaucaucaccaucggcagcgugucccugaccuucgccgccaucugcuuccucaugcagaucgcgauccuggucacgaccgugacccugaacuucaagcaguacgagugcgacccgcccgccaccaaccaggugaugcccugcgagcccaucaucaucgagcgcaacaucacggagaucgucuaccucaccaacaccaccaucgagcgggagaucugcccgaagcugguggaguaccgcaacuggagcaagccccagugcaagaucacgggguucgcccccuucuccaaggacaacagcauccggcuguccgccggcggggacaucugggugacccgcgagcccuacgucagcugcgacccgggccggugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgcguggagcuccagcuccugccacgacggcaaggccuggcuccacgucugcaucaccggguacgacaagaacgccaccgccagcuucaucuacgacggccggcugguggacuccaucgggagcugguccaagaacauccugcgcacccaggagagcgagugcgugugcaucaacgggaccugcacggucgugaugaccgacggcuccgcgagcggccgggccgacacccgcauccucuucaucgaggagggccggaucgugcacaucagcccccuguccgggagcgcccagcacgucgaggagugcuccugcuacccgcgcuaccccggcgugcggugcaucugccgcgacaacuggaagggcagcaaccggcccguggucgacaucaacgugaaggacuacuccaucaacagcuccuacgugugcagcgggcuggucggcgacacgccccgcaacaacgaccgguccagcaacuccuacugccagaacccgaacaacgagaaggggaaccacggcgugaaggggugggccuucgacgacggcaacgacguguggaugggccgcaccaucagcgaggacucccggagcggguaccagaccuucaaggucaucggcgggugguccacccccaacagcaagcuccagaucaaccgccaggugaucgucgacuccgacaaccgcagcggcuacuccgggaucuucagcguggagggcaaguccugcaucaaccggugcuucuacguggagcugauccgcggccggcgccaggagacccgggucugguggacgagcaacagcaucgugguguucugcgggaccuccggcaccuacgggaccggcagcuggcccgacggggccgacaucaaccugaugcccaucuga

SEQ ID NO: 87016 - RNA, 1410 nt, Artificial Sequence
  derived and/or modified sequence opt1 from neuraminidase__InfluenzaA__BAA00620
augaaccccaaccagaagaucaugaccaucggcagcgugucccugaucaucgccgccgucugcuuccucaugcagaucgcgauccuggugaccacggugacccugcacuucaagcagugcgagugcgacagcccguccaacaaccaggucaagcccugcgagcccaucaucaucgagcgcaacaucaccgagaucguguaccucaacaacaccacgaucgagaaggagaccugccccaagcugguggaguaccggaacuggagcaagccgcagugcaagaucaccggguucgcccccuucuccaaggacaacagcauccgccuguccgccggcggggacaucugggucacccgggagcccuacgugagcugcgaccccggcaagugcuaccaguucgcccucgggcagggcacgacccuggacaacaagcacuccaacgacaccauccacgaccgcaucccgcaccggacccugcucaugaacgagcugggcgugcccuuccaccuggggacgcgccaggucugcaucgccuggagcuccagcuccugccacgacggcaaggcguggcuccacgugugcgugaccggggacgacaagaacgccaccgccagcuucaucuacgacggccggcuggucgacuccaucgggagcuggucccagaacauccugcgcacccaggagagcgagugcgugugcaucaacggcacgugcaccguggucaugaccgacggcuccgccagcgggcgggcggacacccgcauccucuucaucgaggagggcaagaucgugcacaucagcccccuguccgggagcgcccagcacguggaggagugcuccugcuacccccgguacccgaacguccgcugcaucugccgggacaacuggaagggcagcaaccgccccaucguggacaucaacaugaaggacuacuccaucgacagcuccuacgugugcagcggccuggucggggacacgccccggaacgacgaccgcuccagcaaguccaacugccggaaccccaacaacgagaagggcaaccacggggugaagggcugggccuucgacaacggggacgacguguggaugggccgcaccaucagcaaggaccuccgguccggcuacgagaccuucaaggucaucgggggcugguucaccccgaacagcaagucccaggugaaccgccaggucaucguggacagcgacaaccgguccggguacagcggcaucuucuccguggagggcaagagcugcaucaaccgcugcuucuacgucgagcugauccgcgggcggggccaggagacgcgcgugugguggaccagcaacuccaucguggucuucugcgggaccagcggcaccuacgggaagggcuccuggcccgacggggccaacaucaacuucaugcccaucuga

SEQ ID NO: 87017 - RNA, 1410 nt, Artificial Sequence
  derived and/or modified sequence opt1 from neuraminidase__InfluenzaA__BAA00621
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaagaacgaccggagcuccagcuccuacugccgcaaccccaacaacgagaaggggacccacggcgugaaggggugggccuucgacgacggcaacgacgucuggaugggccggaccaucagcgaggacucccgcagcggguacgagaccuucaaggugaucggcgggugguccacgccgaacagcaagcuccagaucaaccggcaggucaucguggacuccaacgaccgcagcggcuacuccgggaucuucagcguggagggcaagagcugcaucaaccggugcuucuacgucgagcugauccgcggccgcgagcaggagacccgggugugguggaccuccaacagcaucguggucuucugcgggaccuccggcacguacgggaccggcagcuggcccgacggggccgacaucaaccugaugcccaucuga

SEQ ID NO: 87018 - RNA, 1413 nt, Artificial Sequence
  derived and/or modified sequence opt1 from neuraminidase__InfluenzaA__BAA06714
augaaccccaaccagaagaucaucaccaucggcagcaucuccauggccaucgggaucaucagccugauccuccagaucggcaacaucaucuccaucugggugagccacuccauccagaccgggagccagaaccacacgggcaucugcaaccagcgcaucaucaccuacgagaacuccaccugggucaaccagaccuacgugaacaucaacaacacgaacguggucgccgggaaggacaagaccagcgugacccuggcgggcaacuccagccugugcccgauccggggcugggccaucuacaccaaggacaacuccauccgcaucgggagcaagggcgacguguucgucauccgggagcccuucaucuccugcagccaccucgagugccgcacguucuuccugacccagggggcccugcucaacgacaagcacuccaacggcaccgugaaggaccggagccccuaccgccggcugauguccugcccccugggggaggccccgagccccuacaacucccgcuucgagagcaucgccuggagcgcguccgccugccacgacggcaugggcuggcucaccaucgggaucagcggccccgacgacggggccguggccguccugaaguacaacggcaucaucacggagaccaucaaguccuggaagaagcggauccugcgcacccaggagagcgagugcgugugcgugaacggcuccugcuucaccaucaugacggacgggcccagcaacggccaggcguccuaccggaucuucaagaucgagaaggggaaggucaccaagagcaucgagcucgacgccccgaacucccacuacgaggagugcagcugcuaccccgacaccggcaccgugaugugcgugugccgcgacaacuggcacggguccaaccggcccugggucagcuucaaccagaaccuggacuaccagaucggcuacaucugcuccggcguguucggggacaacccgccgcccaaggacggcaaggggagcugcgaccccgugacggucgacggcgccgacggggugaagggcuucuccuaccgcuacggcaacgggguguggaucggccggaccaagagcaaccgcuuccggaagggguucgagaugaucugggaccccaacggcuggaccgacaccgacuccgacuuccuggucaagcaggacgugguggccaugacggacuggagcggguacuccggcagcuucguccagcaccccgagcucaccggccuggacugcaugcgccccugcuucuggguggagcugguccgggggcgcccccgggagaacaccaccaucuggacgagcggcuccagcaucuccuucugcggggugaacagcgacaccgccaacugguccuggcccgacggcgcggagcucccguucaccaucgacaaguga

SEQ ID NO: 87019 - RNA, 1413 nt, Artificial Sequence
  derived and/or modified sequence opt1 from neuraminidase__InfluenzaA__BAA06715
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuaccgcaucuucaagaucgagaaggggaaggucaccaagagcaucgagcucgacgccccgaacuaccacuacgaggagugcuccugcuaccccgacaccggcaccgugaugugcgugugccgggacaacuggcacgggagcaaccgccccuccgucagcuucaaccagaaccuggacuaccagaucggcuacaucugcuccggcguguucggggacaacccccggccgaaggacggcgaggggagcugcaaccccgugacggucgacggcgcggacggggugaagggcuucuccuaccgcuacggcaacgggguguggaucggccggaccaagagcaaccgccugcggaagggguucgagaugaucugggaccccaacggcuggaccgacaccgacuccgacuucagcgucaagcaggacgugguggccaugacggacugguccggguacagcggcagcuucguccagcaccccgagcucaccggccuggacugcaugcgcccgugcuucuggguggagcugauccgggggcgcccccgggagaagaccaccaucuggacguccggcagcuccaucagcuucugcggggucaacuccgacaccgccaacuggagcuggcccgacggcgccgagcuccccuucaccaucgacaaguga

SEQ ID NO: 87020 - RNA, 1410 nt, Artificial Sequence
  derived and/or modified sequence opt1 from neuraminidase__InfluenzaA__BAA06716
augaacaccaaccagcgcaucaucaccaucggcacgaucugccugaucguggggaucaucagccuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggaccuucuuccugacgcagggggcccuccugaacgaccgccacagcaacggcaccgucaaggaccggucccccuaccgcacccugaugagcugcccgaucggggaggcccccucccccuacaacagccgguucgaguccguggccuggagcgcgagcgccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgagcuacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugagcuucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggcgcggguucgagaugaucugggaccccaacggcuggaccgagacggacagcuccuucagcaugaagcaggacaucaucgcccugaccgacuggagcggguacuccggcagcuucgugcagcaccccgagcugaccggcaugaacugcauccggccgugcuucuggguggagcucauccgcgggcagcccaaggaguccaccaucuggacgagcggcuccagcaucuccuucugcggggucaacagcggcaccgcguccuggagcuggcccgacggcgccgaccugcccuucaccaucgacaaguga

SEQ ID NO: 87021 - RNA, 1413 nt, Artificial Sequence
  derived and/or modified sequence opt1 from neuraminidase__InfluenzaA__BAA06717
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaugaucaccuacgagaacuccaccugggugaaccagaccuacgucaacaucagcaacacgaacgugguggcggggaaggacaagaccuccgucacccuggccggcaacagcucccugugcccgauccggggcugggccaucuacaccaaggacaacagcauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugagcugcccccugggggaggcgccgucccccuacaacagccgguucgagagcguggccugguccgccagcgccugccacgacggcaugggcuggcucaccaucgggaucuccggccccgacgacggggcgguggccguccugaaguacaacggcaucaucacggagaccaucaagagcuggcgcaagcagauccugcggacccaggaguccgagugcgugugcgugaacggcagcugcuucaccaucaugacggacgggcccuccgacggcccggccagcuaccgcaucuucaagaucgagaaggggaaggucaccaaguccaucgagcucgacgcccccaacuaccacuacgaggagugcagcugcuaccccgacaccggcaccgugaugugcgugugccgggacaacuggcacggguccaaccgccccugggucagcuucaaccagaaccuggacuaccagaucggcuacaucugcuccggcguguucggggacaacccgcggcccaaggacggcgaggggagcugcaaccccgugacggucgacggcgccgacggggugaagggcuucuccuaccgcuacggcaacgggguguggaucggccggaccaagagcaaccgccugcggaagggguucgagaugaucugggaccccaacggcuggaccgacaccgacuccgacuucagcgucaagcaggacgugguggcgaugacggacugguccggguacagcggcagcuucguccagcacccggagcucaccggccuggacugcaugcgccccugcuucuggguggagcugauccgggggcgcccccgggagaagaccaccaucuggacguccggcagcuccaucagcuucugcggggucaacuccgacaccgccaacuggagcuggcccgacggcgccgagcucccguucaccaucgacaaguga

SEQ ID NO: 87022 - RNA, 1413 nt, Artificial Sequence
  derived and/or modified sequence opt1 from neuraminidase__InfluenzaA__BAA06718
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccggcgccugaugagcugccccaucggggaggccccgucccccuacaacagccgguucgagagcguggcgugguccgccagcgccugccacgacggcaugggcuggcugaccaucgggaucuccggccccgacgacggggccgucgcggugcucaaguacaacggcaucaucaccgagacgaucaagagcuggcgcaagcggauccugcgcacccaggaguccgagugcgugugcgucaacggcagcugcuucaccaucaugaccgacgggcccaacaacggcccggccuccuaccggaucuucaagaucgagaaggggaagaucaccaagagcaucgagcuggacgcccccaacucccacuacgaggagugcagcugcuaccccgacgccggcacggugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggcgcggguucgagaugaucugggaccccaacggcuggacggacaccgacuccaaguuccuggucaagcaggacgugguggcgaugaccgacuggagcggguacagcggcuccuucguccagcacccggagcugaccggccucgacugcaugcggcccugcuucuggguggagcugguccgcgggcggccccgcgagaacacgaccaucuggaccagcggcuccagcaucuccuucugcggggugaacggcgacaccgccaacuggagcuggcccgacggcgccgagcugccguucacgaucgacaaguga

SEQ ID NO: 87023 - RNA, 1413 nt, Artificial Sequence
  derived and/or modified sequence opt1 from neuraminidase__InfluenzaA__BAA06720
augaaccccaaccagaagaucaucaccaucggcagcaucuccauggccaucgggaucaucagccugauccuccagaucggcaacaucaucuccaucugggugagccacuccauccagaccgggagccagaaccacacgggcaucugcaaccagcgcaucaucaccuacgagaacuccaccugggucaaccagaccuacgugaacaucaacaacacgaacguggucgccgggaaggacaagaccagcgugacccuggcgggcaacuccagccugugcccgauccucggcugggccaucuacaccaaggacaacuccauccggaucgggagcaagggcgacguguucgucauccgcgagcccuucaucuccugcagccaccuggagugccggacguucuuccugacccagggggcccuccugaacgacaagcacuccaacggcaccgugaaggaccgcagccccuaccggcgccugauguccugcccccucggggaggccccgagccccuacaacucccgguucgagagcguggccuggagcgcguccgccugccacgacggcaugggcuggcugaccaucgggaucagcggccccgacgacggggccgucgccgugcugaaguacaacggcaucaucacggagaccaucaaguccuggaagaagcgcauccuccggacccaggagagcgagugcgugugcgucaacggcuccugcuucaccaucaugacggacgggcccagcaacggcgcggccuccuaccgcaucuucaagaucgagaaggggaaggugaccaagagcaucgagcuggacgccccgaacucccacuacgaggagugcagcugcuaccccgacaccggcaccgugaugugcgucugccgggacaacuggcacggguccaaccgccccugggugagcuucaaccagaaccuggacuaccagaucggcuacaucugcuccggcguguucggggacaacccgccgcccaaggacggcaaggggagcugcaaccccgucacgguggacggcgccgacggggugaagggcuucuccuaccgguacggcaacggggucuggaucggccgcaccaagagcaaccgguuccgcaagggguucgagaugaucugggaccccaacggcuggaccgacaccgacuccgacuucagcgugaagcaggacguggucgccaugacggacugguccggguacagcggcagcuucgugcagcaccccgagcucaccggccuggacugcaugcggcccugcuucugggucgagcuggugcgcgggcggccccgcgagaacaccaccaucuggacguccggcagcuccaucagcuucugcggggugaacuccgacaccgcgaacuggagcuggcccgacggcgccgagcucccguucaccaucgacaaguga

SEQ ID NO: 87024 - RNA, 1410 nt, Artificial Sequence
  derived and/or modified sequence opt1 from neuraminidase__InfluenzaA__BAD16637
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggagcacccccaacuccaagagccaggugaaccgccaggucaucgugggcaacaacaacugguccggguacagcggcaucuucagcguggagggcaaguccugcaucaaccggugcuucuacgucgagcugauccgcgggaugccccaggagacccgcgugugguggaccagcaacuccaucguggucuucugcggcaccagcgggacguacggcaccggguccuggcccgacggcgccaacaucaacuucaugccgaucuga

SEQ ID NO: 87025 - RNA, 1410 nt, Artificial Sequence
  derived and/or modified sequence opt1 from neuraminidase__InfluenzaA__BAD16638
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcacgagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggaccuccggcacguacgggaccggcagcuggcccgacggggccaacaucaacuucaugccgaucuga

SEQ ID NO: 87026 - RNA, 1410 nt, Artificial Sequence; identical to SEQ ID NO: 84205
  derived and/or modified sequence opt1 from neuraminidase__InfluenzaA__BAD16639

SEQ ID NO: 87027 - RNA, 1410 nt, Artificial Sequence
  derived and/or modified sequence opt1 from neuraminidase__InfluenzaA__BAD16640
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacaagaacgccaccgccagcuucaucuacgacggccggcucauggacuccaucgggagcuggucccagaacauccugcgcacgcaggagagcgagugcgugugcaucaacgggaccugcaccgucgugaugaccgacggcuccgccagcgggcgggcggacacgcgcauccuguucaucgaggagggcaagaucgugcacaucagcccccucuccgggagcgcccagcacgucgaggagugcuccugcuacccccgguacccggacgugcgcugcaucugccgggacaacuggaagggcagcaaccgccccgugaucgacaucaacauggaggacuacuccaucgacagcuccuacgucugcagcggccuggugggggacacgccccggaacgacgaccgcuccagcaacuccaacugccggaaccccaacaacgagcgcggcaacccgggggugaagggcugggccuucgacaacggggacgacgucuggaugggccggaccaucagcaaggaccugcgcuccggcuacgagaccuucaaggugaucgggggcuggagcacccccaacuccaagagccagaucaaccggcaggucaucguggacuccaacaacuggagcggguacuccggcaucuucagcguggagggcaagagcugcaucaaccgcugcuucuacgucgagcucauccgcggccggcagcaggagacccgcgugugguggaccuccaacagcaucguggucuucugcggcaccuccgggacguacggcaccgggagcuggcccgacggcgccaacaucaacuucaugcccaucuga

SEQ ID NO: 87028 - RNA, 1410 nt, Artificial Sequence
  derived and/or modified sequence opt1 from neuraminidase__InfluenzaA__BAD16641
augaaccccaaccagaagaucaucaccaucggcagcgccucccugaccaucgccacggugugcuuccucaugcagaucgcgauccuggucaccaccgugacccugcacuucaagcagcacgagugcgacagcccggccuccaaccaggugaugcccugcgagcccaucaucaucgagcgcaacacgaccgagaucgucuaccucaacaacaccaccaucgagaaggagaucugccccaaggugguggaguaccggaacuggagcaagccgcagugcaagaucacgggguucgcccccuucuccaaggacaacagcauccgccuguccgccggcggggacaucugggucacccgggagcccuacgugagcugcgaccccggcaagugcuaccaguucgcccuggggcagggcaccacccucgacaacaagcacuccaacgacacgauccacgaccgcaucccgcaccggacccugcugaugaacgagcucggcgugcccuuccaccuggggacccgccaggucugcaucgcguggagcuccagcuccugccacgacggcaaggccuggcugcacgugugcgugaccggggacgacaagaacgccacggccagcuucaucuacgacggccggcucgucgacuccaucgggagcuggucccagaacauccugcgcacccaggagagcgagugcgugugcaucaacgggaccugcaccguggucaugacggacggcuccgcgagcgggcgggccgacacccgcauccuguucaucgaggagggcaagaucgugcacaucagcccccucuccgggagcgcccagcacguggaggagugcuccugcuacccccgguacccggacguccgcugcaucugccgggacaacuggaagggcagcaaccgccccgugguggacaucaacauggaggacuacuccaucgacagcuccuacgucugcagcggccuggugggggacacgccccggaacgacgaccgcuccagcaacuccaacugccggaaccccaacaacgagaagggcaaccagggggugaagggcugggccuucgacaacggggacgacgucuggaugggccgcaccaucagcaaggaccugcgguccggcuacgagaccuucaaggugaucgggggcuggagcaccccgaacuccaagagccagaucaaccgccaggucaucguggacuccgacaaccggagcggguacuccggcaucuucagcguggagggcaagagcugcaucaaccgcugcuucuacgucgagcucauccgcggccggaagcaggagacccgcgugugguggaccuccaacagcaucguggucuucugcggcacguccgggaccuacggcaccgggagcuggcccgacggcgccaacaucaaccugaugcccaucuga

SEQ ID NO: 87029 - RNA, 1410 nt, Artificial Sequence
  derived and/or modified sequence opt1 from neuraminidase__InfluenzaA__BAD16642
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgacaaggagaagugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggagacccgggugugguggaccuccaacagcaucguggucuucugcgggaccuccggcacguacgggaccggcagcuggccggacggggccaacaucaacuucaugcccaucuga

SEQ ID NO: 87030 - RNA, 1410 nt, Artificial Sequence
  derived and/or modified sequence opt1 from neuraminidase__InfluenzaA__BAD16643
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccgggcgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggccucuucaccccgaacagcaagcugcagaucaaccggcaggucaucguggacuccgacaaccgcagcggcuacuccgggaucuucagcguggagggcaaguccugcaucaaccggugcuucuacgucgagcugauccgcggccgcgagcaggagacccgggugugguggacgagcaacagcaucguggucuucugcgggaccuccggcaccuacgggaccggcagcuggcccgacggggccgacaucaaccucaugcccaucuga

SEQ ID NO: 87031 - RNA, 1410 nt, Artificial Sequence
  derived and/or modified sequence opt1 from neuraminidase__InfluenzaA__BAD16644
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcccugcgagcccaucaucaucgagcgcaacaucacggagaucgucuaccucaccaacaccaccaucgagaaggagaucugcccgaagcugguggaguaccggaacugguccaagccccagugcaagaucacgggguucgcgcccuucagcaaggacaacuccauccgccugagcgccggcggggacaucugggugacccgggagcccuacgucuccugcgacccgggcaagugcuaccaguucgcccucgggcagggcaccacccuggacaacaagcacagcaacgacacgauccacgaccgcacgccccaccggacccugcucaugaacgagcugggcgugcccuuccaccuggggacccgccaggugugcaucgccuggucccggagcuccugccacgacggcaaggccuggcuccacgucugcgugaccggguacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcggccgcgccgacaccaagauccucuucaucgaggagggcaagaucguccacaucagcccccuguccgggagcgcgcagcacguggaggagugcuccugcuacccgcgguaccccggcgugcgcugcaucugccgggacaacuggaagggcagcaaccgccccgucguggacaucaacgugaaggacuacuccaucgacagcuccuacgucugcagcgggcuggugggcgacacgccccggaacaacgaccgcuccagcaacuccuacugccggaacccgaacaacgagaaggggaaccacggcgugaaggggugggccuucgacgacggcaacgacgucuggaugggccgcaccaucagcgaggacucccggagcgggugcgagaccuucaaggugaucggcgggugguccacccccaacagcaagcuccagaucaaccgccaggucaucguggacuccgacaaccggagcggcuacuccgggaucuucagcguggagggcaaguccugcaucaaccgcugcuucuacgucgagcugauccgcggccgggagcaggagacccgcgugugguggacgagcaacagcaucguggucuucugcgggaccuccggcaccuacgggaccggcagcuggcccgacggggccgacaucaaccugaugcccaucuga

SEQ ID NO: 87032 - RNA, 1410 nt, Artificial Sequence; identical to SEQ ID NO: 75584
  derived and/or modified sequence opt1 from neuraminidase__InfluenzaA__BAD16645

SEQ ID NO: 87033 - RNA, 1410 nt, Artificial Sequence; identical to SEQ ID NO: 83552
  derived and/or modified sequence opt1 from neuraminidase__InfluenzaA__BAD16646

SEQ ID NO: 87034 - RNA, 1410 nt, Artificial Sequence; identical to SEQ ID NO: 75584
  derived and/or modified sequence opt1 from neuraminidase__InfluenzaA__BAD16647

SEQ ID NO: 87035 - RNA, 1410 nt, Artificial Sequence
  derived and/or modified sequence opt1 from neuraminidase__InfluenzaA__BAD16648
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacgggguacgacaagaacgcgaccgccagcuucaucuacgacggccggcugguggacuccaucgggagcugguccaagaacauccugcgcacccaggagagcgagugcgucugcaucuacgggaccugcacgguggugaugaccgacggcuccgccagcgagcgggccgagaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgacaaccgguccggguacagcggcaucuucagcguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 87036 - RNA, 1410 nt, Artificial Sequence
  derived and/or modified sequence opt1 from neuraminidase__InfluenzaA__BAE07203
augaaccccaaccagaagaucaccaccaucggcagcaucugcauggugaucgggaucgucucccugaugcuccagaucggcaacaucaucagcaucugggugucccacagcauccagacggggaaccagcaccaggccgagccgugcaaccaguccaucaucaccuacgagaacaacaccugggugaaccagaccuacgucaacaucagcaacacgaacuuccugaccgagaaggccguggcguccgugacccuggccggcaacagcucccucugccccaucagcgggugggccgucuacuccaaggacaacggcauccgcaucggcagcaagggggacguguucgugauccgggagcccuucaucuccugcagccaccuggagugccgcaccuucuuccugacgcagggcgcccuccugaacgacaagcacuccaacgggaccgucaaggaccggagcccccaccgcacccugauguccugcccggugggcgaggcccccagccccuacaacucccgguucgagagcguggcguggagcgccuccgccugccacgacgggaccagcuggcucacgaucggcaucuccggccccgacaacggggccgucgcggugcugaaguacaacggcaucaucaccgacaccaucaagagcuggcgcaacaacaucaugcggacccaggaguccgagugcgccugcgugaacgggagcugcuucacggucaugaccgacggcccguccaacggccaggccagcuacaagaucuuccgcaucgagaaggggaagguggugaaguccgccgagcugaacgcccccaacuaccacuacgaggagugcagcugcuaccccgacgcgggcgagaucacgugcgucugccgggacaacuggcacggguccaaccgccccugggugagcuucaaccagaaccucgaguaccggaucggcuacaucugcuccgggguguucggcgacaacccgcgccccaacgacggcaccgggagcugcggccccgucucccccaagggggccuacggcaucaagggguucagcuucaaguacggcaacggcguguggaucgggcggaccaaguccaccaacagccgcuccggcuucgagaugaucugggacccgaacggguggaccggcaccgacagcaacuucagcgugaagcaggacaucgucgccaucacggacugguccggguacagcggcuccuucgugcagcaccccgagcugaccggccuggacugcauccggcccugcuucugggucgagcucauccgcgggcggcccaaggagagcaccaucuggaccuccggcagcuccaucagcuucugcggggugaacuccgacacggugggcuggagcuggccggacggcgccgagcugcccuucaccaucgacaaguga

SEQ ID NO: 87037 - RNA, 1410 nt, Artificial Sequence
  derived and/or modified sequence opt1 from neuraminidase__InfluenzaA__BAF46322
augaaccccaacccgaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuacccgggcguccggugcgugugccgcgacaacuggaaggggagcaaccggcccaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacccgaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgacaucaaccugaugcccaucuga

SEQ ID NO: 87038 - RNA, 1410 nt, Artificial Sequence; identical to SEQ ID NO: 75722
  derived and/or modified sequence opt1 from neuraminidase__InfluenzaA__BAF46323

SEQ ID NO: 87039 - RNA, 1410 nt, Artificial Sequence
  derived and/or modified sequence opt1 from neuraminidase__InfluenzaA__BAF46324
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggagcuccagcuccugccacgacgggaaggccuggcuccacgugugggugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87040 - RNA, 1410 nt, Artificial Sequence
  derived and/or modified sequence opt1 from neuraminidase__InfluenzaA__BAF46332
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcaccacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87041 - RNA, 1410 nt, Artificial Sequence
  derived and/or modified sequence opt1 from neuraminidase__InfluenzaA__BAF46334
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87042 - RNA, 1410 nt, Artificial Sequence; identical to SEQ ID NO: 87041
  derived and/or modified sequence opt1 from neuraminidase__InfluenzaA__BAF46335

SEQ ID NO: 87043 - RNA, 1410 nt, Artificial Sequence
  derived and/or modified sequence opt1 from neuraminidase__InfluenzaA__BAF46337
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgugcggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcuggucgacuccaucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggacuacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggauggcccgcaccaucagcgagaagcugcgguccggcuacgagaccuucaaggugaucgagggcuggagcaaccccaacuccaagcugcagaucaaccgccaggugaucgucgaccgggggaaccgcagcggcuacuccgggaucuucagcguggagggcaagagcugcaucaaccggugcuucuacguggagcucauccgcgggcggaaggaggagaccgagguccuguggaccuccaacagcaucgugguguucugcggcaccuccggcacguacgggaccggcagcuggccggacggggccgacaucaaccugaugcccaucuga

SEQ ID NO: 87044 - RNA, 1410 nt, Artificial Sequence; identical to SEQ ID NO: 87041
  derived and/or modified sequence opt1 from neuraminidase__InfluenzaA__BAF46345

SEQ ID NO: 87045 - RNA, 1410 nt, Artificial Sequence
  derived and/or modified sequence opt1 from neuraminidase__InfluenzaA__BAF46346
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucgcgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcgugacgggcgacgacaagaacgccaccgccagcuucaucuacaacgggcggcugguggacuccaucgucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcgucaucugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87046 - RNA, 1410 nt, Artificial Sequence
  derived and/or modified sequence opt1 from neuraminidase__InfluenzaA__BAF46347
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccaccuucaucuacaacgggcggcugguggacagcaucgucuccuggagcaaggagauccugcgcacgcaggaguccgagugcgugugcaucaacgggaccugcaccguggucaugaccgacgggagcgccuccggcaaggccgacacgaagauccucuucaucgaggagggcaagaucgugcacaccagcacccugagcggguccgcgcagcacguggaggagugcagcugcuacccccgguaccccggcguccgcugcgugugccgggacaacuggaagggguccaaccgcccgaucguggacaucaacaucaaggacuacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucuccgagaagcugcggagcggcuacgagaccuucaaggucaucgaggggugguccaaccccaacagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgacaucaaccugaugcccaucuga

SEQ ID NO: 87047 - RNA, 1410 nt, Artificial Sequence
  derived and/or modified sequence opt1 from neuraminidase__InfluenzaA__BAF46349
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgcccggaccccguaccgcacccugcucaugaacgagcugggcgugcccuuccaccugggcacgaagcaggucugcaucgccuggagcuccagcuccugccacgacgggaaggcguggcuccacgugugcgugaccggcgacgacaagaacgccaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucuucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87048 - RNA, 1410 nt, Artificial Sequence; identical to SEQ ID NO: 87041
  derived and/or modified sequence opt1 from neuraminidase__InfluenzaA__BAF46350

SEQ ID NO: 87049 - RNA, 1410 nt, Artificial Sequence
  derived and/or modified sequence opt1 from neuraminidase__InfluenzaA__BAF46351
augaaccccauccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaugguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87050 - RNA, 1410 nt, Artificial Sequence
  derived and/or modified sequence opt1 from neuraminidase__InfluenzaA__BAF46368
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87051 - RNA, 1410 nt, Artificial Sequence
  derived and/or modified sequence opt1 from neuraminidase__InfluenzaA__BAF46369
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggaagcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuuccaggucaucgaggggugguccaacagcaacuccaagcugcagaucaaccgccaggugaucguggaccggggcaaccgcagcggguacagcggcaucuucuccgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugccgaucuga

SEQ ID NO: 87052 - RNA, 1410 nt, Artificial Sequence
  derived and/or modified sequence opt1 from neuraminidase__InfluenzaA__BAF46370
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcuggccgaguaccggaacuggagcaagccccagugcaacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggagcuccagcuccugccacgacgggaaggccuggcugcacgugugcgugaccggcgacgacaagaacgcgaccgccagcuucaucuacaacgggcgccugguggacuccaucgucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaccagcaucgucguguucugcggcuccagcgggacguacggcaccggguccuggcccgacggcgccgacaucaaccucaugccgaucuga

SEQ ID NO: 87053 - RNA, 1410 nt, Artificial Sequence
  derived and/or modified sequence opt1 from neuraminidase__InfluenzaA__BAF46371
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgugcaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggagcaaccgguccggcuacagcgggaucuucagcgucgagggcaaguccugcaucaaccgcugcuucuacguggagcucauccgggggcgcaaggaggagaccgaggugcuguggaccagcaacuccaucgucguguucugcggcacgagcggcaccuacgggaccggcuccuggccggacggggccgacaucaaccugaugcccaucuga

SEQ ID NO: 87054 - RNA, 1410 nt, Artificial Sequence
  derived and/or modified sequence opt1 from neuraminidase__InfluenzaA__BAF46372
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucgcgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggcguggcuccacgugugcgugacgggcgacgacaagaacgccaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87055 - RNA, 1410 nt, Artificial Sequence
  derived and/or modified sequence opt1 from neuraminidase__InfluenzaA__BAF46385
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccccgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuacccgggcgcccggugcgucugccgcgacaacuggaaggggagcaaccggcccaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaacccgaacuccaagcugcagaccaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcacguccagcaccuacgggaccggcuccuggcccgacggggccgacaucaaccugaugcccaucuga

SEQ ID NO: 87056 - RNA, 1410 nt, Artificial Sequence
  derived and/or modified sequence opt1 from neuraminidase__InfluenzaA__BAF46386
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccagcaccuacgggaccggcuccuggccggacggggccgacaucaaccugaugcccaucuga

SEQ ID NO: 87057 - RNA, 1410 nt, Artificial Sequence; identical to SEQ ID NO: 77572
  derived and/or modified sequence opt1 from neuraminidase__InfluenzaA__BAF46387

SEQ ID NO: 87058 - RNA, 1410 nt, Artificial Sequence
  derived and/or modified sequence opt1 from neuraminidase__InfluenzaA__BAF46388
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccggcaggacaucguggaccgcggcaaccggagcggguacuccggcaucuucagcguggagggcaagagcugcaucaaccgcugcuucuacgucgagcucauccgggggcgcaaggaggagaacgaggugcuguggaccuccaacagcaucguggucuucugcggcaccuccgggaccuacggcacggggagcuggccggacggcgccgacaucaaccugaugcccaucuga

SEQ ID NO: 87059 - RNA, 1410 nt, Artificial Sequence
  derived and/or modified sequence opt1 from neuraminidase__InfluenzaA__BAF47922
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacauccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgccagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 87060 - RNA, 1410 nt, Artificial Sequence; identical to SEQ ID NO: 75702
  derived and/or modified sequence opt1 from neuraminidase__InfluenzaA__BAF47923

SEQ ID NO: 87061 - RNA, 1410 nt, Artificial Sequence
  derived and/or modified sequence opt1 from neuraminidase__InfluenzaA__BAF47924
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacagcgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaccaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 87062 - RNA, 1410 nt, Artificial Sequence; identical to SEQ ID NO: 75720
  derived and/or modified sequence opt1 from neuraminidase__InfluenzaA__BAF47925

SEQ ID NO: 87063 - RNA, 1410 nt, Artificial Sequence; identical to SEQ ID NO: 75720
  derived and/or modified sequence opt1 from neuraminidase__InfluenzaA__BAF47926

SEQ ID NO: 87064 - RNA, 1410 nt, Artificial Sequence; identical to SEQ ID NO: 81707
  derived and/or modified sequence opt1 from neuraminidase__InfluenzaA__BAF47927

SEQ ID NO: 87065 - RNA, 1410 nt, Artificial Sequence; identical to SEQ ID NO: 77572
  derived and/or modified sequence opt1 from neuraminidase__InfluenzaA__BAF47928

SEQ ID NO: 87066 - RNA, 1410 nt, Artificial Sequence
  derived and/or modified sequence opt1 from neuraminidase__InfluenzaA__BAF47929
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaccgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccgacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaacgaggugcuguggaccuccaacagcaucgucguguucugcggcaccuccgggacguacggcaccgggagcuggccggacggcgccgacaucaaccugaugcccaucuga

SEQ ID NO: 87067 - RNA, 1410 nt, Artificial Sequence
  derived and/or modified sequence opt1 from neuraminidase__InfluenzaA__BAF47930
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaccgucagcuccuacgugugcagcggccuggugggggacacgccccgcaagaacgacuccagcuccagcggccacugccucgaccccaacaacgaggagggcgggcacggggucaagggcugggccuucgacgacggcaacgacguguggauggggcggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 87068 - RNA, 1410 nt, Artificial Sequence; identical to SEQ ID NO: 81707
  derived and/or modified sequence opt1 from neuraminidase__InfluenzaA__BAF47931

SEQ ID NO: 87069 - RNA, 1410 nt, Artificial Sequence
  derived and/or modified sequence opt1 from neuraminidase__InfluenzaA__BAF47932
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 87070 - RNA, 1410 nt, Artificial Sequence; identical to SEQ ID NO: 75720
  derived and/or modified sequence opt1 from neuraminidase__InfluenzaA__BAF47933

SEQ ID NO: 87071 - RNA, 1410 nt, Artificial Sequence; identical to SEQ ID NO: 75722
  derived and/or modified sequence opt1 from neuraminidase__InfluenzaA__BAF47934

SEQ ID NO: 87072 - RNA, 1410 nt, Artificial Sequence; identical to SEQ ID NO: 75722
  derived and/or modified sequence opt1 from neuraminidase__InfluenzaA__BAF47935

SEQ ID NO: 87073 - RNA, 1410 nt, Artificial Sequence
  derived and/or modified sequence opt1 from neuraminidase__InfluenzaA__BAF47936
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcgggcacugccucgaccccaacaacgaggagggcgggcacggcgugaaggggugggccuucgacgacggcaacgacgucuggaugggccggaccaucuccgagaagcugcgcagcggguacgagaccuucaaggugaucgagggcugguccaaccccaacagcaagcugcagaucaaccggcaggucaucguggaccgcgggaaccgguccggcuacagcgggaucuucuccguggagggcaagagcugcaucaaccgcugcuucuacgucgagcucauccggggccgcaaggaggagaccgaggugcuguggaccagcaacuccaucguggucuucugcgggaccagcggcacguacgggaccggcuccuggccggacggggccgacaucaaccugaugcccaucuga

SEQ ID NO: 87074 - RNA, 1410 nt, Artificial Sequence
  derived and/or modified sequence opt1 from neuraminidase__InfluenzaA__BAF47937
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcggccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 87075 - RNA, 1410 nt, Artificial Sequence
  derived and/or modified sequence opt1 from neuraminidase__InfluenzaA__BAF47938
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcuggccgaguaccggaacuggagcaagccccagugcaacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacggccgcacccccuaccggacccuccugaugaacgagcugggcgugccguuccaccucgggacgaagcaggucugcaucgccuggagcuccagcuccugccacgacggcaaggccuggcugcacgugugcgugaccggggacgacaagaacgcgaccgccagcuucaucuacaacggccgccugguggacuccaucgucagcugguccaaggagauccuccggacccaggagagcgagugcgugugcaucaacgggacgugcaccguggucaugaccgacggcuccgccagcggcaaggccgacaccaagauccuguucaucgaggaggggaagaucgugcacacgagcacccuguccggcagcgcgcagcacguggaggagugcuccugcuacccccgcuaccccgggguccggugcgugugccgcgacaacuggaagggcagcaaccggcccaucguggacaucaacaucaaggacuacuccaucgucagcuccuacgugugcagcggccucgugggggacaccccgcgcaagaccgacuccagcuccagcucccacugccuggaccccaacaacgaggagggcgggcacggcgucaaggggugggccuucgacgacggcaacgacguguggaugggccggacgaucagcgagaagcugcgcuccggguacgagaccuucaaggucaucgagggcuggagcaaccccaacuccaagcuccagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcuguggaccuccaacagcaucgucguguucugcgggacguccggcaccuacgggaccggcagcuggcccgacggggccgacaucaaccucaugccgaucuga

SEQ ID NO: 87076 - RNA, 1410 nt, Artificial Sequence; identical to SEQ ID NO: 75722
  derived and/or modified sequence opt1 from neuraminidase__InfluenzaA__BAF47939

SEQ ID NO: 87077 - RNA, 1410 nt, Artificial Sequence
  derived and/or modified sequence opt1 from neuraminidase__InfluenzaA__BAF47940
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggagaagaccgaggugcuguggaccuccaacagcaucgucguguucugcggcaccuccgggacguacggcaccgggagcuggccggacggcgccgacaucaaccugaugcccaucuga

SEQ ID NO: 87078 - RNA, 1410 nt, Artificial Sequence; identical to SEQ ID NO: 75720
  derived and/or modified sequence opt1 from neuraminidase__InfluenzaA__BAF47941

SEQ ID NO: 87079 - RNA, 1410 nt, Artificial Sequence
  derived and/or modified sequence opt1 from neuraminidase__InfluenzaA__BAF47943
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaucgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 87080 - RNA, 1410 nt, Artificial Sequence
  derived and/or modified sequence opt1 from neuraminidase__InfluenzaA__BAF47944
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcugaccgaguaccggaacuggagcaagccgcagugcaacaucaccggguucgcccccuucuccaaggacaacagcauccgccuguccgcgggcggggacaucugggucacccgggagcccuacgugagcugcgaccccgacaagugcuaccaguucgcccucggccaggggacgacccugaacaacgugcacuccaacgacccgguccacgaccgcacccccuaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgccaccgcgagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcccagcacguggaggagugcuccugcuacccccgcuacccgggcguccggugcgugugccgcgacaacuggaaggggagcaaccggcccaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggcguucgacgacgggaacgacguguggaugggccggaccaucagcgagaagcugcgcuccggcuacgagaccuucaaggucaucgagggguggagcaacccgaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgacaucaaccugaugcccaucuga

SEQ ID NO: 87081 - RNA, 1410 nt, Artificial Sequence
  derived and/or modified sequence opt1 from neuraminidase__InfluenzaA__BAF47945
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaagcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 87082 - RNA, 1410 nt, Artificial Sequence
  derived and/or modified sequence opt1 from neuraminidase__InfluenzaA__BAF47946
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaagguccuggagggguggagcaaccccaacuccaagcuccagaccaaccgccaggugaucguggaccggggcaaccggagcggguacuccggcaucuucagcgucgagggcaagagcugcaucaaccgcugcuucuacguggagcugauccgggggcgcaaggaggagaccgaggugcuguggaccuccaacagcaucgucguguucugcggcacguccgggaccuacggcaccgggagcuggccggacggcgccgacaucaaccucaugcccaucuga

SEQ ID NO: 87083 - RNA, 1410 nt, Artificial Sequence
  derived and/or modified sequence opt1 from neuraminidase__InfluenzaA__BAF47948
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaagguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaacuccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggaccuacggcacgggguccuggcccgacggcgccgacaucaaccugaugccgaucuga

SEQ ID NO: 87084 - RNA, 1410 nt, Artificial Sequence
  derived and/or modified sequence opt1 from neuraminidase__InfluenzaA__BAF47949
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaagguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87085 - RNA, 1410 nt, Artificial Sequence; identical to SEQ ID NO: 75722
  derived and/or modified sequence opt1 from neuraminidase__InfluenzaA__BAF47950

SEQ ID NO: 87086 - RNA, 1410 nt, Artificial Sequence
  derived and/or modified sequence opt1 from neuraminidase__InfluenzaA__BAF47951
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 87087 - RNA, 1410 nt, Artificial Sequence
  derived and/or modified sequence opt1 from neuraminidase__InfluenzaA__BAF47952
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccaacaucaaccugaugcccaucuga

SEQ ID NO: 87088 - RNA, 1410 nt, Artificial Sequence
  derived and/or modified sequence opt1 from neuraminidase__InfluenzaA__BAF47953
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 87089 - RNA, 1410 nt, Artificial Sequence; identical to SEQ ID NO: 87041
  derived and/or modified sequence opt1 from neuraminidase__InfluenzaA__BAF47954

SEQ ID NO: 87090 - RNA, 1410 nt, Artificial Sequence; identical to SEQ ID NO: 87041
  derived and/or modified sequence opt1 from neuraminidase__InfluenzaA__BAF47955

SEQ ID NO: 87091 - RNA, 1410 nt, Artificial Sequence
  derived and/or modified sequence opt1 from neuraminidase__InfluenzaA__BAF47956
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacuucaugcccaucuga

SEQ ID NO: 87092 - RNA, 1410 nt, Artificial Sequence
  derived and/or modified sequence opt1 from neuraminidase__InfluenzaA__BAF47958
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugaugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcggcucguggacuccaucgucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagcuccgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggaccgacggcgccgacaucaacuucaugccgaucuga

SEQ ID NO: 87093 - RNA, 1410 nt, Artificial Sequence
  derived and/or modified sequence opt1 from neuraminidase__InfluenzaA__BAF47959
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacuacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 87094 - RNA, 1410 nt, Artificial Sequence
  derived and/or modified sequence opt1 from neuraminidase__InfluenzaA__BAF47960
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 87095 - RNA, 1410 nt, Artificial Sequence
  derived and/or modified sequence opt1 from neuraminidase__InfluenzaA__BAF47975
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccacaugcccaucuga

SEQ ID NO: 87096 - RNA, 1410 nt, Artificial Sequence; identical to SEQ ID NO: 75720
  derived and/or modified sequence opt1 from neuraminidase__InfluenzaA__BAF47976

SEQ ID NO: 87097 - RNA, 1410 nt, Artificial Sequence
  derived and/or modified sequence opt1 from neuraminidase__InfluenzaA__BAF47977
augaaccccaaccagaagaucaucaccaucggcagcgugucccugaccaucagcacgaucugcuucuucaugcagaucgccauccucaucaccaccgucacccugcaguucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaccaaccgccaggugaucguggaccgggggaaccggagcggcuacuccgggaucuucagcgucgagggcaagagcugcaucaaccgcugcuucuacguggagcucauccggggccgcaaggaggagaccgaggugcuguggaccuccaacagcaucgucguguucugcgggacguccggcaccuacgggaccggcagcuggccggacggggccgacaucaaccugaugcccaucuga

SEQ ID NO: 87098 - RNA, 1410 nt, Artificial Sequence
  derived and/or modified sequence opt1 from neuraminidase__InfluenzaA__BAF47978
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgccuggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 87099 - RNA, 1410 nt, Artificial Sequence
  derived and/or modified sequence opt1 from neuraminidase__InfluenzaA__BAF47979
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 87100 - RNA, 1410 nt, Artificial Sequence; identical to SEQ ID NO: 77572
  derived and/or modified sequence opt1 from neuraminidase__InfluenzaA__BAF47980

SEQ ID NO: 87101 - RNA, 1410 nt, Artificial Sequence
  derived and/or modified sequence opt1 from neuraminidase__InfluenzaA__BAF47981
augaaccccaaccagaagaucaucaccaucggcagcgugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaaguggagcaagccgcagugcaacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccgcaaccggaccccguaccgcacccuccugaugaacgagcugggcgugcccuuccaccucggcacgaagcaggucugcaucgccuggagcuccagcuccugccacgacgggaaggccuggcugcacgugugcgugaccggcgacgacaagaacgcgaccgccagcuucaucuacaacgggcggcugguggacuccaucgucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 87102 - RNA, 1410 nt, Artificial Sequence
  derived and/or modified sequence opt1 from neuraminidase__InfluenzaA__BAF47982
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87103 - RNA, 1410 nt, Artificial Sequence; identical to SEQ ID NO: 77572
  derived and/or modified sequence opt1 from neuraminidase__InfluenzaA__BAF47983

SEQ ID NO: 87104 - RNA, 1410 nt, Artificial Sequence
  derived and/or modified sequence opt1 from neuraminidase__InfluenzaA__BAF47984
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgaccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 87105 - RNA, 1410 nt, Artificial Sequence
  derived and/or modified sequence opt1 from neuraminidase__InfluenzaA__BAF47985
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 87106 - RNA, 1410 nt, Artificial Sequence
  derived and/or modified sequence opt1 from neuraminidase__InfluenzaA__BAF47986
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgccgguucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 87107 - RNA, 1410 nt, Artificial Sequence
  derived and/or modified sequence opt1 from neuraminidase__InfluenzaA__BAF47987
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaagguccacgaccgcaccccguaccggacccugcucaugaacgagcugggcgugcccuuccaccugggcaccaagcaggucugcaucgccugguccagcuccagcugccacgacgggaaggccuggcuccacgugugcgugacgggcgacgacaagaacgcgaccgccuccuucaucuacaacgggcgccugguggacagcaucgucuccuggagcaagaagauccugcggacccaggaguccgagugcgugugcaucaacgggaccugcacgguggucaugaccgacgggagcgccuccggcaaggccgacaccaagauccucuucaucgaggagggcaagaucgugcacaccagcacgcugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcggccacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggaccuacggcacgggguccuggccggacggcgccgacaucaaccugaugcccaucuga

SEQ ID NO: 87108 - RNA, 1410 nt, Artificial Sequence; identical to SEQ ID NO: 75722
  derived and/or modified sequence opt1 from neuraminidase__InfluenzaA__BAF47988

SEQ ID NO: 87109 - RNA, 1410 nt, Artificial Sequence; identical to SEQ ID NO: 75722
  derived and/or modified sequence opt1 from neuraminidase__InfluenzaA__BAF47989

SEQ ID NO: 87110 - RNA, 1410 nt, Artificial Sequence
  derived and/or modified sequence opt1 from neuraminidase__InfluenzaA__BAF47990
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccgugaucaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccgugagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 87111 - RNA, 1410 nt, Artificial Sequence
  derived and/or modified sequence opt1 from neuraminidase__InfluenzaA__BAF47991
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcauccggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcggccacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 87112 - RNA, 1410 nt, Artificial Sequence
  derived and/or modified sequence opt1 from neuraminidase__InfluenzaA__BAF47992
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgagcccgacaagugcuacccguucgcccucgugcagggcaccacgcugaacaacguccacuccaacgacaccgugcacgaccgcacccccuaccggacccugcucaugaacgagcugggggugcccuuccaccugggcacgaagcaggucugcaucgccuggagcuccagcuccugccacgacggcaaggccuggcuccacgugugcgugaccggggacgacaagaacgcgaccgccagcuucaucuacaacggccgccuggucgacuccaucgugagcugguccaaggagauccugcggacccaggagagcgagugcgugugcaucaacgggacgugcaccgucgugaugaccgacggcuccgccagcgggaaggccgacaccaagauccucuucaucgaggagggcaagaucgugcacacgagcacccuguccggcagcgcgcagcacgucgaggagugcuccugcuacccccgcuacccgggggugcggugcgugugccgcgacaacuggaagggcagcaaccggcccaucgucgacaucaacaucaaggacuacuccaucgugagcuccuacgugugcagcgggcuggucggcgacacgccccgcaagaacgacuccagcuccagcggccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaacccgaacagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccagcaacuccuucgugguguucugcggcaccagcgggacguacggcaccggguccuggcccgacggcgccgacaucaaccugaugcccaucuga

SEQ ID NO: 87113 - RNA, 1410 nt, Artificial Sequence; identical to SEQ ID NO: 87069
  derived and/or modified sequence opt1 from neuraminidase__InfluenzaA__BAF47993

SEQ ID NO: 87114 - RNA, 1410 nt, Artificial Sequence; identical to SEQ ID NO: 75720
  derived and/or modified sequence opt1 from neuraminidase__InfluenzaA__BAF47994

SEQ ID NO: 87115 - RNA, 1410 nt, Artificial Sequence
  derived and/or modified sequence opt1 from neuraminidase__InfluenzaA__BAF47995
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacaagaacgcgaccgccagcuucaucuacaacggccgccugguggacuccaucgucagcugguccaaggagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 87116 - RNA, 1410 nt, Artificial Sequence; identical to SEQ ID NO: 87115
  derived and/or modified sequence opt1 from neuraminidase__InfluenzaA__BAF47996

SEQ ID NO: 87117 - RNA, 1410 nt, Artificial Sequence; identical to SEQ ID NO: 75722
  derived and/or modified sequence opt1 from neuraminidase__InfluenzaA__BAF47997

SEQ ID NO: 87118 - RNA, 1410 nt, Artificial Sequence
  derived and/or modified sequence opt1 from neuraminidase__InfluenzaA__BAF57504
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucagcaaggacaacuccauccgccugagcgccggcggggacaucugggucacccgggagcccuacguguccagcgacccggacaagugcuaccaguucgcccucggccaggggaccacgcugaacaacgugcacuccaacgacaccguccacgaccgcacccccuaccggacccugcucaugaaggagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccgucgugagcugguccaagaagauccugcggacccaggagagcgagugcgugugcaucaacggcacgugcaccgucgugaugaccgacggguccgccagcggcaaggccgacaccaagauccucuucaucgaggagggcaagaucgugcacacgagcucccugagcggguccgcgcagcacgucgaggagugcagcugcuacccccgcuacccgggcgugcggugcgugugccgcgacaacuggaagggguccaaccggcccaucgucgacaucaacaucaaggacuacagcaucguguccagcuacgugugcuccggccuggucggcgacacgccccgcaagaacgacagcuccagcuccagccacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaacccgaacagcaagcugcagaucaaccgccaggugaucgucgaccggggcaaccgguccggguacagcggcaucuucagcguggaggggaaguccugcaucaaccgcugcuucuacguggagcucauccggggccgcaagcaggagaccgagguccuguggaccagcaacuccaucgugguguucugcggcaccagcgggaccuacggcacgggguccuggcccgacggcgccgacaucaaccugaugcccaucuga

SEQ ID NO: 87119 - RNA, 1410 nt, Artificial Sequence
  derived and/or modified sequence opt1 from neuraminidase__InfluenzaA__BAF57508
augaaccccaaccagaagaucaucaccaucggcagcgugucccugaccaucagcacgaucugcuucuucaugcagaucgccauccucaucaccacccugacccugcacuucaagcaguacgaguucaacuccccgcccaacaaccaggucaugcucugcgagcccacgaucaucgagcgcaacaucaccgagaucguguaccugaccaacaccacgaucgagaaggagaucugccccaagcuggccgaguaccggaacuggagcaagccgcagugcaacaucaccggguucgcgcccuucuccaaggacaacagcauccgccucuccgccggcggggacaucugggugacccgggagcccuacgucagcugcgaccccgacaagugcuaccaguucgcccugggccaggggaccacgcugaacaacgugcacuccaacgacaccgugcacgaccgcaccccguaccggacccuccugaugaacgagcugggcguccccuuccaccucggcacgaagcaggucugcaucgccuggagcuccagcuccugccacgacgggaaggccuggcugcacgugugcgugaccggcgacgacgagaacgcgaccgccagcuucaucuacaacgggcgccugguggacuccaucgugagcugguccaagaagauccuccggacccaggagagcgagugcgucugcaucaacggcacgugcaccguggugaugaccgacggguccgccagcggcaaggccgacaccaagauccuguucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccucgugggcgacacgccccgcaagaacgacuccagcuccagcucccacugccuggaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcuccagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcuguggaccuccaacagcaucguggucuucugcggcaccuccgggacguacggcaccgggagcuggccggacggcgccgacaucaaccucaugcccaucuga

SEQ ID NO: 87120 - RNA, 1410 nt, Artificial Sequence; identical to SEQ ID NO: 76937
  derived and/or modified sequence opt1 from neuraminidase__InfluenzaA__BAF57511

SEQ ID NO: 87121 - RNA, 1410 nt, Artificial Sequence
  derived and/or modified sequence opt1 from neuraminidase__InfluenzaA__BAF57515
augaaccccaaccagcgcaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggagcaagccgcagugcaacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacgacaagguccacgaccggaccccguaccgcacccugcucaugaacgagcugggcgugcccuuccaccugggcaccaagcaggucugcaucgccuggagcuccagcuccugccacgacgggaaggccuggcuccacgugugcgugacgggcgacgacgagaacgcgaccgccagcuucaucuacaacgggcggcugguggacuccaucgucagcugguccaagaagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuaccugugcagcggccucgugggcgacacgccccggaagaacgacuccagcuccagcucccacugccuggaccccaacaacgaggagggcggccacggggugaagggcugggccuucgacgacgggaacgacgucuggaugggccgcaccaucagcgagaagcugcgguccggcuacgagaccuucaaggugaucgagggguggagccaccccaacucccagcuccagaucaaccgccaggucaucguggaccggggcaaccgcagcggguacuccggcaucuucagcguggagggcaagagcugcaucaaccggugcuucuacgucgagcugauccgcgggcggaagcaggagaccgaggugcuguggaccuccaacagcaucguggucuucugcggcaccuccgggaccuacggcacggggagcuggccggacggcgccgacaucaaccucaugcccaucuga

SEQ ID NO: 87122 - RNA, 1410 nt, Artificial Sequence
  derived and/or modified sequence opt1 from neuraminidase__InfluenzaA__BAF57522
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagcuggccgaguaccggaacuggagcaagccgcagugcaacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacgagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgaccggucccgcagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaagcccaacuccaagcugcagaucaaccgccaggugaucguggaccggggcaaccggaccggguacagcggcaucuucuccgucgagggcaagagcugcaucaaccgcugcuucuacguggagcucauccgggggcgcaagcaggagaccgaggugcuguggaccuccaacagcaucgucguguucugcggcaccagcgggacguacggcaccggguccuggccggacggcgccgacaucaaccugaugcccaucuga

SEQ ID NO: 87123 - RNA, 1410 nt, Artificial Sequence
  derived and/or modified sequence opt1 from neuraminidase__InfluenzaA__BAF57529
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaagguccacgagcgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87124 - RNA, 1410 nt, Artificial Sequence; identical to SEQ ID NO: 82559
  derived and/or modified sequence opt1 from neuraminidase__InfluenzaA__BAF57532

SEQ ID NO: 87125 - RNA, 1410 nt, Artificial Sequence; identical to SEQ ID NO: 82559
  derived and/or modified sequence opt1 from neuraminidase__InfluenzaA__BAF57536

SEQ ID NO: 87126 - RNA, 1410 nt, Artificial Sequence
  derived and/or modified sequence opt1 from neuraminidase__InfluenzaA__BAF57539
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugaucgacuccaucgugagcugguccaagaagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggagaagaccgaggugcuguggaccuccaacagcaucguggucuucugcggcaccuccgggacguacggcaccgggagcuggccggacggcgccgacaucaaccugaugcccaucuga

SEQ ID NO: 87127 - RNA, 1410 nt, Artificial Sequence
  derived and/or modified sequence opt1 from neuraminidase__InfluenzaA__BAF57543
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccgccaucuucagcgucgagggcaagagcugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 87128 - RNA, 1410 nt, Artificial Sequence
  derived and/or modified sequence opt1 from neuraminidase__InfluenzaA__BAF57547
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggcccuguggaccuccaacagcaucguggucuucugcggcaccuccgggacguacggcaccgggagcuggccggacggcgccgacaucaaccugaugcccaucuga

SEQ ID NO: 87129 - RNA, 1410 nt, Artificial Sequence; identical to SEQ ID NO: 75722
  derived and/or modified sequence opt1 from neuraminidase__InfluenzaA__BAF57551

SEQ ID NO: 87130 - RNA, 1410 nt, Artificial Sequence; identical to SEQ ID NO: 75722
  derived and/or modified sequence opt1 from neuraminidase__InfluenzaA__BAF57555

SEQ ID NO: 87131 - RNA, 1410 nt, Artificial Sequence; identical to SEQ ID NO: 75720
  derived and/or modified sequence opt1 from neuraminidase__InfluenzaA__BAF57559

SEQ ID NO: 87132 - RNA, 1410 nt, Artificial Sequence
  derived and/or modified sequence opt1 from neuraminidase__InfluenzaA__BAF57563
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaaggagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 87133 - RNA, 1410 nt, Artificial Sequence; identical to SEQ ID NO: 75720
  derived and/or modified sequence opt1 from neuraminidase__InfluenzaA__BAF57571

SEQ ID NO: 87134 - RNA, 1410 nt, Artificial Sequence; identical to SEQ ID NO: 82464
  derived and/or modified sequence opt1 from neuraminidase__InfluenzaA__BAF57575

SEQ ID NO: 87135 - RNA, 1410 nt, Artificial Sequence; identical to SEQ ID NO: 75335
  derived and/or modified sequence opt1 from neuraminidase__InfluenzaA__BAF57579

SEQ ID NO: 87136 - RNA, 1410 nt, Artificial Sequence
  derived and/or modified sequence opt1 from neuraminidase__InfluenzaA__BAF57583
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacauccgggucacccgcgagcccuacgugagcugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 87137 - RNA, 1410 nt, Artificial Sequence
  derived and/or modified sequence opt1 from neuraminidase__InfluenzaA__BAF57587
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 87138 - RNA, 1410 nt, Artificial Sequence
  derived and/or modified sequence opt1 from neuraminidase__InfluenzaA__BAF57591
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucgugcacaucaacaucaaggacuacuccaucgucagcuccuacgugugcagcggccuggugggcgacacgccccgcaagaacgacuccagcuccagcucccacugccucaaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 87139 - RNA, 1410 nt, Artificial Sequence
  derived and/or modified sequence opt1 from neuraminidase__InfluenzaA__BAF57595
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagaucgccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcgugaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccuggaccccaacaacgaggagggcgggcacggggugaagggcugggccuucgacgacgggaacgacgucuggaugggccggaccaucagcgagaagcuccgcuccggcuacgagaccuucaaggugaucgagggguggagcaaccccaacuccaagcugcagaucaaccgccaggugaucgucgaccggggcaaccggagcggguacuccggcaucuucagcguggagggcaagagcugcaucaaccgcugcuucuacguggagcugauccgggggcgcaaggaggagaccgagguccucuggaccuccaacagcaucgugguguucugcggcaccuccgggacguacggcaccgggagcuggccggacggcgccgacaucaaccugaugcccaucuga

SEQ ID NO: 87140 - RNA, 1410 nt, Artificial Sequence; identical to SEQ ID NO: 82464
  derived and/or modified sequence opt1 from neuraminidase__InfluenzaA__BAF57599

SEQ ID NO: 87141 - RNA, 1410 nt, Artificial Sequence
  derived and/or modified sequence opt1 from neuraminidase__InfluenzaA__BAF57603
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccgacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcugggcaccuccaacagcaucgucguguucugcgggaccuccggcacguacgggaccggcagcuggccggacggggccgacaucaaccugaugcccaucuga

SEQ ID NO: 87142 - RNA, 1410 nt, Artificial Sequence; identical to SEQ ID NO: 82559
  derived and/or modified sequence opt1 from Neuraminidase__InfluenzaA__BAF62620

SEQ ID NO: 87143 - RNA, 1413 nt, Artificial Sequence
  derived and/or modified sequence opt1 from neuraminidase__InfluenzaA__BAF63036
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucacgaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggagcggguacagcggcuccuucguccagcaccccgagcucaccggccuggacugcauccgccccugcuucuggguggagcugguccgggggcucccgcgcgagaacaccacgaucuggaccagcggcuccagcaucuccuucugcggggugaacagcgacaccgccaacugguccuggcccgacggcgccgagcugcccuucaccaucgacaaguga

SEQ ID NO: 87144 - RNA, 1413 nt, Artificial Sequence; identical to SEQ ID NO: 82449
  derived and/or modified sequence opt1 from neuraminidase__InfluenzaA__BAF63040

SEQ ID NO: 87145 - RNA, 1413 nt, Artificial Sequence
  derived and/or modified sequence opt1 from neuraminidase__InfluenzaA__BAF63047
augaaccccaaccagaagaucaucaccaucggcagcaucuccaucgccaucgggaucaucagccuggugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggugaacagcgacaccgccgacugguccuggcccgacggcgccgagcugcccuucaccaucgacaaguga

SEQ ID NO: 87146 - RNA, 1413 nt, Artificial Sequence
  derived and/or modified sequence opt1 from neuraminidase__InfluenzaA__BAF63058
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcgccaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcgcugaugagcugcccccugggggaggcccccuccccguacaacagcaaguucgagagcguggccugguccgccagcgcgugccacgacggcaugggcuggcucaccaucgggaucuccggccccgacaacggggccguggccguccugaaguacaacggcaucaucacggagaccaucaagagcuggaagaagcgcauccugcggacccaggaguccgagugcgugugcgugaacggcagcugcuucaccaucaugacggacgggcccuccaacgaggccgccagcuacaagaucuucaagaucgagaagggcaaggucaccaaguccaucgagcucaacgcgcccaacuuccacuacgaggagugcagcugcuacccggacaccgggaccgugaugugcgugugccgcgacaacuggcacggcuccaaccggcccugggucagcuucaaccccaaccuggacuaccagaucggguacaucugcuccggcguguucggcgacaacccccgcccgaaggacggggagggcagcugcaaccccgugacggucgacggggccgacggcgugaagggguucuccuacaaguacggcaacggcguguggaucgggcggaccaagagcaaccgccugcggaagggcuucgagauggucugggaccccaacggguggaccgacaccgacuccgacuucagcgugaagcaggacguggucgccaucacggacugguccggcuacagcgggagcuucgugcagcaccccgagcucaccggccuggacugcauccgcccgugcuucugggucgagcuggugcggggccuccccaaggagaacaccaccaucuggacguccgggagcuccaucagcuucugcggcgugaacuccgacaccgccaacuggagcuggcccgacggggccgagcugcccuucaccaucgacaaguga

SEQ ID NO: 87147 - RNA, 1413 nt, Artificial Sequence; identical to SEQ ID NO: 82449
  derived and/or modified sequence opt1 from neuraminidase__InfluenzaA__BAF63065

SEQ ID NO: 87148 - RNA, 1413 nt, Artificial Sequence; identical to SEQ ID NO: 82449
  derived and/or modified sequence opt1 from neuraminidase__InfluenzaA__BAF63069

SEQ ID NO: 87149 - RNA, 1413 nt, Artificial Sequence; identical to SEQ ID NO: 82449
  derived and/or modified sequence opt1 from neuraminidase__InfluenzaA__BAF63079

SEQ ID NO: 87150 - RNA, 1413 nt, Artificial Sequence; identical to SEQ ID NO: 82449
  derived and/or modified sequence opt1 from neuraminidase__InfluenzaA__BAF63092

SEQ ID NO: 87151 - RNA, 1413 nt, Artificial Sequence; identical to SEQ ID NO: 82449
  derived and/or modified sequence opt1 from neuraminidase__InfluenzaA__BAF63098

SEQ ID NO: 87152 - RNA, 1413 nt, Artificial Sequence
  derived and/or modified sequence opt1 from neuraminidase__InfluenzaA__BAF63104
augaaccccaaccagaagaucaucaccaucggcagcaucuccaucgccaucgggaucaucagccugaugcuccaggugggcaucgucguguccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucgcccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcgcugauguccugcccccugggggaggcccccagcccguacaacagcaaguucgaguccguggccuggagcgccuccgcgugccacgacggcaugggcuggcucaccaucgggaucagcggccccgacaacggggccguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggcaggucaccaagagcguggagcucaacgcgcccaacuuccacuacgaggagugcuccugcuacccggacacgggcaccgugaugugcgucugccgcgacaacuggcacgggagcaaccggcccuggguguccuucaaccagaaccuggacuaccagaucggcuacaucugcagcggcguguucggggacaacccccgccccaaggacggcaagggguccugcaacccggucaccguggacggcgccgacggggugaagggcuucagcuacaaguacggcaacggggucuggaucggccggacgaaguccaaccgccugcggaagggguucgagaugaucugggaccccaacggcuggaccgacaccgacagcgacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccagcggcuccagcaucuccuucugcgggguggacagcgacacggccaacugguccuggcccgacggcgccgagcugcccuucaccaucgacaaguga

SEQ ID NO: 87153 - RNA, 1413 nt, Artificial Sequence
  derived and/or modified sequence opt1 from neuraminidase__InfluenzaA__BAF63112
augaaccccaaccagaagaucaucaccaucggcagcaucuccaucgccaucgggaucaucagccugaugcuccaggugggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcguggcccuggccggcaacuccagccugugcuccaucagcggcugggccaucuacaccaaggacaacuccauccggaucgggagcaagggcgacguguucgucauccgcgagccguucaucuccugcagccaccucgagugccggaccuucuuccugacgcagggggcccugcucaacgacaagcacuccaacggcaccgugaaggaccgcagccccuaccgggcgcugauguccugcccccugggggaggcccccagcccguacaacagcaaguucgaguccguggccuggagcgccuccgcgugccacgacggcaugggcuggcucaccaucgggaucagcggccccgacaacggggccgucgccgugcugaaguacaacggcaucaucaccgagacgaucaaguccuggaagaagcgcauccugcggacccaggagagcgagugcgugugcgucaacggcuccugcuucaccaucaugaccgacgggcccagcaacggcgccgccuccuacaagaucuucaagaucgagaagggccaggugaccaagagcguggagcucaacgcgcccaacuuccacuacgaggagugcuccugcuacccggacacggggaccgucaugugcgugugccgcgacaacuggcacgggagcaaccggcccuggguguccuucaaccagaaccuggacuaccagaucggcuacaucugcagcggcgucuucggggacaacccccgccccaaggacggcaagggguccugcaacccggugaccguggacggcgccgacggggucaagggcuucagcuacaaguacggcaacgggguguggaucggccggacgaaguccaaccgccugcggaagggguucgagaugaucugggaccccaacggcuggaccgacaccgacagcgacuucuccgugaagcaggacgucguggccaucaccgacuggagcggguacagcggcuccuucguccagcaccccgagcucacgggccuggacugcauccgccccugcuucuggguggagcuggugcgggggcucccgcgcgagaacaccaccaucuggaccagcggcuccagcaucuccuucugcggggucgacagcgacacggccaacugguccuggcccgacggcgccgagcugcccuucaccaucgacaaguga

SEQ ID NO: 87154 - RNA, 1413 nt, Artificial Sequence
  derived and/or modified sequence opt1 from neuraminidase__InfluenzaA__BAF63116
augaaccccaaccagaagaucaucaccaucggcagcaucuccaucgccaucgggaucaucagccugaugcuccaggugggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcguggcccuggccggcaacuccagccugugcuccaucagcggcugggccaucuacaccaaggacaacuccauccggaucgggagcaagggcgacguguucgucauccgcgagccguucaucuccugcagccaccucgagugccggaccuucuuccugacgcagggggcccugcucaacgacaagcacuccaacggcaccgugaaggaccgcagccccuaccgggcgcugauguccugcccccugggggaggcccccagcccguacaacagcaaguucgaguccguggccuggagcgccuccgcgugccacgacggccucggcuggcugaccaucgggaucagcggccccgacaacggggccgucgccgugcugaaguacaacggcaucaucaccgagacgaucaaguccuggaagaagcgcauccuccggacccaggagagcgagugcgugugcgucaacggcuccugcuucaccaucaugaccgacgggcccagcaacggcgccgccuccuacaagaucuucaagaucgagaagggccaggugaccaagagcguggagcugaacgcgcccaacuuccacuacgaggagugcuccugcuacccggacacggggaccgucaugugcgugugccgcgacaacuggcacgggagcaaccggcccuggguguccuucaaccccgaccuggacuaccagaucggcuacaucugcagcggcgucuucggggacaacccccgcccgaaggacggcaagggguccugcaaccccgugaccguggacggcgccgacggggucaagggcuucagcuacaaguacggcaacgggguguggaucggccggacgaaguccaaccgccuccggaagggguucgagaugaucugggaccccaacggcuggaccgacaccgacagcgacuucuccgugaagcaggacgucguggccaucaccgacuggagcggguacagcggcuccuucguccagcaccccgagcugacgggccuggacugcauccgcccgugcuucuggguggagcucgugcgggggcugccccgcgagaacaccaccaucuggaccagcggcuccagcaucuccuucugcggggucgacagcgacacggccaacugguccuggcccgacggcgccgagcugcccuucaccaucgacaaguga

SEQ ID NO: 87155 - RNA, 1413 nt, Artificial Sequence
  derived and/or modified sequence opt1 from neuraminidase__InfluenzaA__BAF63124
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagccgcgagcucaacgcccccaacuuccacuacgaggagugcuccugcuacccggacaccggcaccgugaugugcgugugccgggacaacuggcacgggagcaaccgccccugggucuccuucaaccccaaccuggacuaccagaucggcuacaucugcagcggcguggugggggacaacccccggccgaaggacggcaagggguccugcaaccccgucacggcggacggcgccgacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggccgugcuucuggguggagcugguccgcgggcucccccgggagaacaccaccaucuggacgagcggcuccagcaucuccuucugcgggguggacagcgacaccgccaacugguccuggcccgacggcgccgagcugcccuucaccaucgacaaguga

SEQ ID NO: 87156 - RNA, 1413 nt, Artificial Sequence; identical to SEQ ID NO: 82511
  derived and/or modified sequence opt1 from neuraminidase__InfluenzaA__BAF63132

SEQ ID NO: 87157 - RNA, 1413 nt, Artificial Sequence
  derived and/or modified sequence opt1 from neuraminidase__InfluenzaA__BAF63136
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugcaagacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagagcgagugcgugugcaugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggcuacaucugcagcggggucuucggcgacaacccccgccccaaggacggggagggcuccugcaacccggugacgguggacggggcgaacggcgucaagggcuucagcuacaaguacgggaacggcguguggaucgggcggaccaaguccaaccgccugcggaagggcuucgagaugaucugggaccccaacggguggaccaacaccgacagcgacuucuccgugaagcaggacgucguggccaucacggacuggagcggcuacagcggcuccuucgugcagcaccccgagcucaccgggcuggacugcauccgccccugcuucugggucgagcuggugcggggccucccgcgcgagaacaccaccaucuggacgagcggguccagcaucuccuucugcggcgucaacagcgacaccgccaacugguccuggcccgacggcgccgagcugcccuucaccaucgacaaguga

SEQ ID NO: 87158 - RNA, 1350 nt, Artificial Sequence
  derived and/or modified sequence opt1 from neuraminidase__InfluenzaA__BAH24021
augaaccccaaccagaagaucaucaccaucggcagcaucugcauggugaucgggaucgucucccugaugcuccagaucggcaacauggugagccugugggugucccacagcauccagaccgggaaccagcaccaggucgagccgaucuccaacacgaacuuccugaccgagaaggccguggccagcgugacccucgcgggcaacuccagccugugccccauccgcgggugggccguccacuccaaggacaacagcauccggaucggcuccaagggcgacguguucgugauccgcgagcccuucaucagcugcucccaccuggagugccggaccuucuuccucacgcagggggcccugcugaacgacaagcacagcaacggcaccgucaaggaccgcagcccccaccggacccucaugagcugcccggugggggaggcccccucccccuacaacagccgcuucgaguccguggccuggagcgcgagcgccugccacgacggcaccuccuggcugacgaucgggaucagcggccccgacaacggcgccgucgccgugcugaaguacaacgggaugaucaccgacaccaucaaguccuggcggaacaacauccuccgcacccaggagagcgagugcgcgugcgugaacggcuccugcuucacggucaugaccgacgggccgagcaacggccaggccuccuacaagaucuucaagauggagaagggcaagguggugaaguccgucgagcuggacgcccccaacuaccacuacgaggagugcuccugcuaccccgacgccggggagaucacgugcgugugccgggacaacuggcacggcagcaaccgccccuggguguccuucaaccagaaccuggaguaccagaucggguacaucugcagcggcgucuucggggacaacccgcggcccaacggcggcaccggguccugcggccccgugagccccaacggggccuacggcgugaagggguucuccuucaaguacggcaacggcgucuggaucgggcgcaccaagagcccguccagccgguccggcuucgagaugaucugggaccccaacggguggaccgagaccgacagcagcuucuccgugaagcaggacaucgucgcgaucaccgacuggagcggcuacuccgggagcuucgugcagcaccccgagcucacgggccuggacugcauccgccccugcuucuggguggagcugauccggggccgcccgaaggaguccaccaucuggaccagcggguccagcaucuccuucugcggcgucaacagcgacaccguguccuggagcuggcccgacggggccgagcuccccuucacgaucgacaaguga

SEQ ID NO: 87159 - RNA, 1410 nt, Artificial Sequence; identical to SEQ ID NO: 77901
  derived and/or modified sequence opt1 from neuraminidase__InfluenzaA__BAH95825

SEQ ID NO: 87160 - RNA, 1410 nt, Artificial Sequence; identical to SEQ ID NO: 77736
  derived and/or modified sequence opt1 from neuraminidase__InfluenzaA__BAH95826

SEQ ID NO: 87161 - RNA, 1410 nt, Artificial Sequence
  derived and/or modified sequence opt1 from neuraminidase__InfluenzaA__BAJ07994
augaaccccaaccagaagaucaccaccaucggcagcaucugcauggugaucgggaucgucucccugaugcuccagaucggcaacaucaucagcaucugggugucccacagcauccagacggggaaccagcaccaggccgagccgugcaaccaguccaucaucaccuacgagaacaacaccugggugaaccagaccuacgucaacaucagcaacacgaacuuccugaccgagaaggccguggcguccgugacccuggccggcaacagcucccucugccccaucagcgggugggccgucuacuccaaggacaacggcauccgcaucggcagcaagggggacguguucgugauccgggagcccuucaucuccugcagccaccuggagugccgcaucuucuuccugacccagggcgcccuccugaacgacaagcacuccaacgggacggucaaggaccggagcccccaccgcacccugauguccugcccggugggcgaggcccccagccccuacaacucccgguucgagagcguggcguggagcgccuccgccugccacgacgggaccagcuggcucaccaucggcaucuccggccccgacaacggggccgucgcggugcugaaguacaacggcaucaucacggacaccaucaagagcuggcgcaacaacaucaugcggacccaggaguccgagugcgccugcgugaacgggagcugcuucaccgucaugacggacggcccguccaacggccaggccagcuacaagaucuuccgcaucgagaaggggaagguggugaaguccgccgagcugaacgcccccaacuaccacuacgaggagugcagcugcuaccccgacgcgggcgagaucacgugcgucugccgggacaacuggcacggguccaaccgccccugggugagcuucaaccagaaccucgaguaccggaucggcuacaucugcuccgggguguucggcgacaacccgcgccccaacgacggcaccgggagcugcggccccgucucccccaagggggccuacggcaucaagggguucagcuucaaguacggcaacggcguguggaucgggcggaccaaguccaccaacagccgcuccggcuucgagaugaucugggacccgaacggguggaccggcaccgacagcaacuucagcgugaagcaggacaucgucgccaucaccgacugguccggguacagcggcuccuucgugcagcaccccgagcugacgggccuggacugcauccggcccugcuucugggucgagcucauccgcgggcggcccaaggagagcaccaucuggaccuccggcagcuccaucagcuucugcggggugaacuccgacaccgugggcuggagcuggccggacggcgccgagcugcccuucacgaucgacaaguga

SEQ ID NO: 87162 - RNA, 1350 nt, Artificial Sequence
  derived and/or modified sequence opt1 from neuraminidase__InfluenzaA__BAK23415
augaaccccaaccagaagaucaucaccaucggcagcgugugcaugaucaucgggaucgucucccugaugcuccagaucggcaacaugaucagcaucuggguggggcacuccauccagaccggcaaccagugccacgccgagccgaucagcaacacgaaguuccccaccgagaaggccgcggccuccgugacccuggccgggaacagcucccugugccccaucagcggcugggccgucuacuccaaggacaacagcauccgcaucggcucccgcggggacguguucgugauccgggagcccuucaucagcugcucccaccucgagugccggaccuucuuccugacgcagggcgcccugcucaacgacaagcacagcaacgggaccgucaaggaccgcuccccgcaccggacccugaugagcugccccgugggcgaggcgcccucccccuacaacagccgcuucgaguccguggccuggagcgccagcgccugccacgacgggaccuccuggcugacgaucggcaucagcggcccggacaacggggcggucgccgugcucaaguacaacggcaucaucaccgacaccaucaaguccuggcggaacaacauccugcgcacccaggagagcgagugcgccugcaucaacggguccugcuucacggugaugaccgacggccccagcuccggccaggccagcuacaagaucuucaagauggagaaggggaaggucgugaaguccguggagcuggacgcccccaacuaccacuacgaggagugcagcugcuaccccgacgcgggcgagaucacgugcgucugccgggacaacuggcacggguccaaccgcccgugggugagcuucaaccagaaccucgaguaccagaucggcuacaucugcuccgggguguucggcgacaacccccggcccaacgacggcaccgggagcugcggccccgucuccccgaacggggccuacggcgugaagggguucagcuucaaguacggcaacggcguguggaucgggcgcaccaaguccaccaacagccgguccggcuucgagaugaucugggaccccaacggguggaccggcaccgacagcagcuucuccgucaagcaggacaucguggccaucacggacuggagcggguacuccggcagcuucgugcagcaccccgagcugaccggccuggacugcauccgccccugcuucugggucgagcucauccgggggcgcccgaaggaguccaccaucuggaccagcggcuccagcaucuccuucugcggggugaacagcgacacggucuccuggagcuggcccgacggcgccgagcugcccuucaccaucgacaaguga

SEQ ID NO: 87163 - RNA, 1350 nt, Artificial Sequence
  derived and/or modified sequence opt1 from neuraminidase__InfluenzaA__BAK23416
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgcgagccccaacggcgccuacggggugaagggcuucuccuucaaguacgggaacggcgucuggaucggccgcaccaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcugaccggccucgacugcauccgccccugcuucuggguggagcugauccggggccgccccaaggagagcaccaucuggaccuccgggagcuccaucagcuucugcggcgucaacuccgacacggugagcugguccuggccggacggggccgagcugcccuucaccaucgacaaguga

SEQ ID NO: 87164 - RNA, 1350 nt, Artificial Sequence
  derived and/or modified sequence opt1 from neuraminidase__InfluenzaA__BAK23417
augaaccccaaccagaagaucaucaccaucggcagcaucugcauggugaucgggaucgucucccugaugcuccagaucggcaacaugaucagcaucugggugucccacagcauccagaccgggaaccagugccaguccgagccgaucagcaacacgaaguuccugaccgagaaggccguggccuccgucacccuggcgggcaacagcucccucugccccaucagcgggugggccguguacuccaaggacaacagcauccgcaucggcucccggggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgagagcgucgccugguccgcgagcgccugccacgacggcaucuccuggcucaccaucgggaucagcggccccgacaacggcgccguggccgugcugaaguacaacgggaucaucacggacaccaucaaguccuggcggaacaacauccugcgcacccaggagagcgagugcgcgugcgucaacggcuccugcuucaccgugaugacggacgggccgagcuccggccaggccagcuacaagaucuucaagauggagaagggcaagguggucaaguccguggagcucgacgcccccaacuaccacuacgaggagugcagcugcuaccccgacgccggggagaucacgugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccgugucccccaacggcgccuacggggucaagggcuucagcuucaaguacgggaacggcguguggaucggccgcaccaaguccaccaacagccggagcggguucgagaugaucugggacccgaacggcuggaccgggaccgacuccagcuucuccgugaagcaggacaucgucgcgaucaccgacuggagcggcuacuccgggagcuucgugcagcaccccgagcugacgggccucgacugcauccgccccugcuucugggucgagcugauccggggccgccccaaggaguccaccaucuggaccagcggguccagcaucuccuucugcggcgugaacggggacaccgugagcugguccuggccggacggcgccgagcugcccuucacgaucgacaaguga

SEQ ID NO: 87165 - RNA, 1350 nt, Artificial Sequence
  derived and/or modified sequence opt1 from neuraminidase__InfluenzaA__BAK23418
augaaccccaaccagaccaucaucaccaucggcagcaucugcauggugaucgggaucgucucccugaugcuccagaucggcaacaugaucagcaucugggugucccacagcauccagacggggaaccagugccaggccgagccgaucuccaacaccaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggacguucuuccugacccagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcacgagcuggcucaccaucgggaucuccggccccgacaacggcgccguggcggugcugaaguacaacgggaucaucaccgacaccaucaagagcuggcggaacaacauccugcgcacgcaggaguccgagugcgccugcgucaacggcagcugcuucaccgugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggacggacagcuccuucagcgugaagcaggacaucgucgccaucaccgacugguccggcuacagcggguccuucgugcagcaccccgagcugaccggccucgacugcauccgccccugcuucugggucgagcugauccggggccgccccaaggagagcaccaucuggacguccgggagcuccaucagcuucugcggcgugaacuccgacaccgugagcugguccuggccggacggggccgagcugcccuucaccaucgacaaguga

SEQ ID NO: 87166 - RNA, 1350 nt, Artificial Sequence; identical to SEQ ID NO: 77585
  derived and/or modified sequence opt1 from neuraminidase__InfluenzaA__BAK23420

SEQ ID NO: 87167 - RNA, 1350 nt, Artificial Sequence; identical to SEQ ID NO: 77585
  derived and/or modified sequence opt1 from neuraminidase__InfluenzaA__BAK23421

SEQ ID NO: 87168 - RNA, 1350 nt, Artificial Sequence
  derived and/or modified sequence opt1 from neuraminidase__InfluenzaA__BAK23422
augaaccccaaccagaagaucaucaccaucggcagcgugugcauggucaucgggaucgugucccugaugcuccagaucggcaacaugaucagcaucuggguggggcacuccauccagaccggcaaccagugccacgccgagccgaucagcaacacgaaguuccccaccgagaaggccgcggccuccgucacccuggccgggaacagcucccugugccccaucagcggcugggccguguacuccaaggacaacagcauccgcaucggcucccgcggggacguguucgucauccgggagcccuucaucagcugcucccaccucgagugccggaccuucuuccugacgcagggcgcccugcucaacgacaagcacagcaacgggaccgugaaggaccgcuccccgcaccggacccugaugagcugccccgugggcgaggcgcccucccccuacaacagccgcuucgaguccgucgccuggagcgccagcgccugccacgacgggaccuccuggcugacgaucggcaucagcggcccggacaacggggcgguggccgugcucaaguacaacggcaucaucaccgacaccaucaaguccuggcggaacaacauccugcgcacccaggagagcgagugcgccugcgucaacggguccugcuucacggugaugaccgacggccccagcuccggccaggccagcuacaagaucuucaagauggagaaggggaagguggucaaguccguggagcuggacgcccccaacuaccacuacgaggagugcagcugcuaccccgacgcgggcgagaucacgugcgugugccgggacaacuggcacggguccaaccgcccgugggucagcuucaaccagaaccucgaguaccagaucggcuacaucugcuccgggguguucggcgacaacccccggcccaacgacggcaccgggagcugcggccccguguccccgaacggggccuacggcgucaagggguucagcuucaaguacggcaacggcguguggaucgggcgcaccaaguccaccaacagccgguccggcuucgagaugaucugggaccccaacggguggaccggcaccgacagcagcuucuccgugaagcaggacaucgucgccaucacggacuggagcggguacuccggcagcuucgugcagcaccccgagcugaccggccuggacugcauccgccccugcuucugggucgagcucauccgggggcgcccgaaggaguccaccaucuggaccagcggcuccagcaucuccuucugcggggugaacagcgacacgguguccuggagcuggcccgacggcgccgagcugcccuucaccaucgacaaguga

SEQ ID NO: 87169 - RNA, 1350 nt, Artificial Sequence
  derived and/or modified sequence opt1 from neuraminidase__InfluenzaA__BAK23423
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccacgaccaaguuccugaccgagaaggccguggcgagcgucacccuggccggcaacuccagccucugccccaucuccgggugggccguguacagcaaggacaacuccauccgcaucggcccccggggcgacguguucgucauccgcgagcccuucaucagcugcucccaccuggagugccggacguucuuccugacccagggggcccuccugaacgacaagcacagcaacggcaccgugaaggaccgcuccccgcaccggacccugaugagcugccccgugggggaggcccccucccccuacaacagccgcuucgaguccgucgcguggagcgccagcgccugccacgacggcaucuccuggcucacgaucgggaucagcggcccggacaacggcgccguggcggugcugaaguacaacgggaucaucaccgacaccaucaaguccuggcggaacaacauccugcgcacccaggagagcgagugcgccugcgucaacggcuccugcuucacggugaugaccgacgggcccagcuccggccaggccagcuacaagaucuucaagauggagaagggcaagguggucaaguccguggagcucgacgcccccaacuaccacuacgaggagugcagcugcuaccccgacgccggggagaucacgugcgugugccgggacaacuggcacggcuccaaccgcccgugggucagcuucaaccagaaccuggaguaccagaucggguacaucugcuccggcguguucggggacaacccccggcccaacgacggcaccggcagcugcgggcccguguccccgaacggcgcguacggggucaagggcuucagcuucaaguacgggaacggcguguggaucggccgcaccaaguccaccaacagccgguccggguucgagaugaucugggaccccaacggcuggaccgggaccgacagcagcuucuccgugaagcaggacaucgucgccaucacggacuggagcggcuacuccgggagcuucgugcagcaccccgagcugaccggccucgacugcauccgccccugcuucugggucgagcugauccggggccgcccgaaggaguccaccaucuggaccagcggguccagcaucuccuucugcggcgugaacagcgacacgguguccuggagcuggcccgacggggccgagcugcccuucaccaucgacaaguga

SEQ ID NO: 87170 - RNA, 1350 nt, Artificial Sequence
  derived and/or modified sequence opt1 from neuraminidase__InfluenzaA__BAK23424
augaaccccaaccagaagaucaucaccaucggcagcaucugcauggugaucgggaucgucucccugaugcuccagaucggcaacaugaucagcaucugggugucccacagcauccagaccgggaaccagugccagggcgagccgaucuccaacacgaaguuccugaccgagaaggccguggccagcgucacccuggcggggaacuccagccucugccccaucuccggcugggccguguacagcaaggacaacuccauccgcaucggcagccgcggggacguguucgucauccgggagcccuucaucuccugcagccaccuggagugccggaccuucuuccugacgcagggcgcccuccugaacgacaagcacuccaacgggaccgugaaggaccgcagcccccaccggacccugauguccugcccggugggcgaggcccccagccccuacaacucccgcuucgagagcgucgccuggagcgcguccgccugccacgacgggaccagcuggcucacgaucggcaucuccggccccgacaacggggccguggccgugcugaaguacaacggcaucaucaccgacaccaucaagagcuggcggaacaacauccugcgcacccaggaguccgagugcgcgugcgucaacgggagcugcuucacggugaugaccgacggcccguccagcggccaggccuccuacaagaucuucaagauggagaaggggaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacggcaccggguccugcggccccguguucagcaacggggccuacggcgucaagggguucuccuucaaguacggcaacggcguguggaucgggcgcaccaagagcaccaacucccggagcggcuucgagaugaucugggaccccaacggguggaccggcaccgacagcuccuucagcgggaagcaggacaucguggcgaucacggacugguccggcuacagcggcuccuucguccagcacccggagcugaccgggcucgacugcauccgccccugcuucuggguggagcugauccggggccgccccaaggagagcaccaucuggaccuccgggagcuccaucagcuucugcggcgucaacuccgacacggugagcugguccuggcccgacggcgccgagcugccguucaccaucgacaaguga

SEQ ID NO: 87171 - RNA, 1350 nt, Artificial Sequence
  derived and/or modified sequence opt1 from neuraminidase__InfluenzaA__BAK23425
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaucagcuggcucaccaucgggaucuccggccccgacaacggcgccguggcggugcugaaguacaacgggaucaucacggacaccaucaagagcuggcggaacaacauccugcgcacccaggaguccgagugcgccugcgucaacggcagcugcuucaccgugaugacggacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaucgggaccgacagcuccuucagcgugaagcaggacaucgucgccaucaccgacugguccggcuacagcggguccuucgugcagcaccccgagcugaccggccucgacugcauccgccccugcuucugggucgagcugauccggggccgccccaaggagagcacgaucuggaccuccgggagcuccaucagcuucugcggcgugaacuccgacaccgugagcugguccuggccggacggggccgagcugcccuucaccaucgacaaguga

SEQ ID NO: 87172 - RNA, 1350 nt, Artificial Sequence
  derived and/or modified sequence opt1 from neuraminidase__InfluenzaA__BAK23426
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguucuucaccgagaaggccguggcgagcgucacccuggccggcaacuccagccugugccccaucuccgggugggccguguacagcaaggacaacuccauccgcaucggcagccggggcgacguguucaucauccgcgagcccuucaucuccugcagccaccucgagugccggaccuucuuccugacgcagggggcccugcucaacgacaagcacuccaacggcaccgucaaggaccgcagcccccaccggacccugauguccugcccggugggggaggcccccagccccuacaacucccgcuucgagagcguggcguggagcgccuccgccugccacgacggcaccagcuggcugacgaucgggaucuccggccccgacaacggcgccgucgcggugcucaaguacaacgggaucaucaccgacaccaucaagagcuggcggaacaacauccugcgcacccaggaguccgagugcgccugcgugaacggcagcugcuucacggucaugaccgacgggccguccagcggccaggccuccuacaagaucuucaagauggagaagggcaagguggucaagagcguggagcuggacgcccccaacuaccacuacgaggagugcuccugcuaccccgacgccggggagaucacgugcgugugccgggacaacuggcacggcagcaaccgccccuggguguccuucaaccagaaccucgaguaccagaucggguacaucugcagcggcgucuucggggacaacccgcggcccaacgacggcaccggcuccugcgggcccgugagccccaacggcgcguacggggugaagggcuucuccuucaaguacgggaacggcgucuggaucggccgcaccaagagcaccaacucccggagcggguucgagaugaucugggacccgaacggcuggaccgggaccgacagcuccuucagcgugaagcaggacaucguggccaucacggacugguccggcuacagcggguccuucguccagcaccccgagcugaccggccuggacugcauccgccccugcuucuggguggagcucauccggggccgccccaaggagagcaccaucuggaccuccgggagcuccaucagcuucugcggcgucaacuccgacacggugagcugguccuggccggacggggccgagcugcccuucaccaucgacaaguga

SEQ ID NO: 87173 - RNA, 1350 nt, Artificial Sequence; identical to SEQ ID NO: 87171
  derived and/or modified sequence opt1 from neuraminidase__InfluenzaA__BAK23427

SEQ ID NO: 87174 - RNA, 1350 nt, Artificial Sequence
  derived and/or modified sequence opt1 from neuraminidase__InfluenzaA__BAK23428
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggaccgacagcuccgugagcgucaagcaggacaucguggccaucacggacugguccggcuacagcggguccuucguccagcaccccgagcugaccggccucgacugcauccgccccugcuuccggguggagcugauccgcggccggcccaaggagagcaccaucuggaccuccgggagcuccaucagcuucugcggcgugaacuccgacacggucagcugguccuggccggacggggccgagcugcccuucaccaucgacaaguga

SEQ ID NO: 87175 - RNA, 1350 nt, Artificial Sequence; identical to SEQ ID NO: 87171
  derived and/or modified sequence opt1 from neuraminidase__InfluenzaA__BAK23429

SEQ ID NO: 87176 - RNA, 1350 nt, Artificial Sequence
  derived and/or modified sequence opt1 from neuraminidase__InfluenzaA__BAK23430
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaucagcuggcucaccaucgggaucuccggccccgacaacggcgccguggcggugcugaaguacaacgggaucaucacggacaccaucaagagcuggcggaacaacauccugcgcacccaggaguccgagugcgccugcgucaacggcagcugcuucaccgugaugacggacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaucgggaccgacagcuccuucagcgugaagcaggacaucgucgccaucaccgacugguccggcuacagcggguccuucgugcagcaccccgagcugaccggccucgacugcaugcgccccugcuucugggucgagcugauccggggccgccccaaggagagcacgaucuggaccuccgggagcuccaucagcuucugcggcgugaacuccgacaccgugagcugguccuggccggacggggccgagcugcccuucaccaucgacaaguga

SEQ ID NO: 87177 - RNA, 1350 nt, Artificial Sequence
  derived and/or modified sequence opt1 from neuraminidase__InfluenzaA__BAK23431
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggcgccguggcggugcugaaguacaacgggaucaucaccgacaccaucaagagcuggcggaacaacauccugcgcacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucuggggcccgaacggguggaccggcaccgacagcuccuucagcgugaagcaggacaucgucgccaucacggacugguccggguacagcggcuccuucgugcagcaccccgagcugaccggccucgacugcauccgccccugcuucugggucgagcugauccgggggcgccccaaggagagcaccaucuggaccuccggcagcuccaucagcuucugcggggugaacuccgacacggugagcugguccuggccggacggcgccgagcugcccuucaccaucgacaaguga

SEQ ID NO: 87178 - RNA, 1350 nt, Artificial Sequence; identical to SEQ ID NO: 87171
  derived and/or modified sequence opt1 from neuraminidase__InfluenzaA__BAK23432

SEQ ID NO: 87179 - RNA, 1350 nt, Artificial Sequence; identical to SEQ ID NO: 87171
  derived and/or modified sequence opt1 from neuraminidase__InfluenzaA__BAK23433

SEQ ID NO: 87180 - RNA, 1410 nt, Artificial Sequence
  derived and/or modified sequence opt1 from neuraminidase__InfluenzaA__BAM65748
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuuccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaccgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgggggcuggagcaaccccaacuccaagagccagaucaaccgccaggugaucguggacauggggaaccgguccggcuacagcgggaucuucagcgucgagggcaaguccugcaucaaccggugcuucuacguggagcugauccgcggccggaaggacgagaccgaggugcucuggaccagcaacuccaucgucguguucugcgggacgagcggcaccuacgggaccggcuccuggccggacggggccgacaucaagcugaugagcaucuga

SEQ ID NO: 87181 - RNA, 1350 nt, Artificial Sequence
  derived and/or modified sequence opt1 from neuraminidase__InfluenzaA__BAM85817
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccgugcugaaguacaacgggaucaucaccgacaccaucaagagcuggcgcaacaacauccugcggacccaggaguccgagugcgcgugcgucaacggcagcugcuucacggugaugaccgacgggccguccaacggccaggccagccacaagaucuucaagauggagaagggcaagguggucaaguccguggagcucgacgcccccaacuaccacuacgaggagugcagcugcuaccccaacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccguguccagcaacggcgccuacggggucaagggcuucuccuucaaguacgggaacggcguguggaucggccggaccaagagcaccaacucccgcagcggguucgagaugaucugggaccccaacggcuggaccgagaccgacagcuccuucagcgugaagcaggacaucgucgcgaucacggacugguccggguacagcggcuccuucgugcagcacccggagcugaccgggcucgacugcauccggcccugcuucugggucgagcugauccgcggccggcccaaggagagcaccaucuggaccuccggcagcuccaucagcuucugcggggugaacuccgacacggugggcuggagcuggcccgacggggccgagcugccguucaccaucgacaaguga

SEQ ID NO: 87182 - RNA, 1350 nt, Artificial Sequence
  derived and/or modified sequence opt1 from neuraminidase__InfluenzaA__BAM85818
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccauccgggggugggccgugcacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcgugguccgccagcgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagcuacaagaucuucaagauggagaagggcaagguggucaaguccguggagcucaacgcccccaacuaccacuacgaggagugcagcugcuaccccgacgccggggagaucaucugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccgugucccccaacggcgcguacgggaucaagggcuucagcuucaaguacgggaacggcgucuggaucggccggaccaaguccacgaacagccgcuccggguucgagaugaucugggacccgaacggcuggaccgggaccgacagcaacuucuccgugaagcaggacaucguggccaucaccgacuggagcggcuacagcggguccuucguccagcaccccgagcugacgggccucgacugcauccggcccugcuucuggguggagcugauccgcggccggcccaaggagagcaccaucuggaccuccgggagcuccaucagcuucugcggcgucaacuccgacaccgugagcugguccuggccggacggggccgagcugcccuucacgaucgacaaguga

SEQ ID NO: 87183 - RNA, 1350 nt, Artificial Sequence
  derived and/or modified sequence opt1 from neuraminidase__InfluenzaA__BAM85819
augaaccccaaccagaagaucaucaccaucggcagcaucugcauggugaucgggaucgucucccugaugcuccagaucggcaacaugaucagcaucugggugucccacagcauccagaccgggaaccagaaccagguggagccgaucaucaacacgaacuuccugaccgagaaggccgucgccuccaucacccuggcgggcaacagcucccucugccccauccgcgggugggccauccacagcaaggacaacuccauccggaucggcagcaagggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggccugguccgcgagcgccugccacgacggcaccagcuggcucacgaucgggaucuccggccccgacaacggcgccgucgccgugcugaaguacaacgggaucaucaccgacaccaucaagagcuggcggaacaacauccugcgcacccaggaguccgagugcgcgugcgugaacggcagcugcuucacggucaugaccgacgggccguccgacggccaggccagcuacaagaucuucaagauggagaagggcaaggugaucaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucucccacaacggcgccuacggggugaagggcuucagcuucaaguacgggaacggcguguggaucggccgcaccaagucccccaacagccgguccggguucgagaugaucugggacccgaacggcuggagcgagaccgacuccagcuucagcgucaagcaggacaucguggcgaucaccgacugguccggguacagcggcuccuucgugcagcaccccgagcugaccgggcucgacugcauccgccccugcuucugggucgagcugauccggggccgccccaaggagagcacgguguggaccuccggcagcuccaucagcuucugcggggucuccagcgacaccguguccuggagcuggccggacggcgccgagcugcccuucaccaucgacaaguga

SEQ ID NO: 87184 - RNA, 1350 nt, Artificial Sequence
  derived and/or modified sequence opt1 from neuraminidase__InfluenzaA__BAM85820
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgaucuccaacacgaacuuccugaccgagaaggccguggcgagcgucacccuggccggcaacuccagccucugccccauccgcgggugggccgugcacuccaaggacaacagcauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacggcgccguggcggugcugaaguacaacgggaucaucaccgacaccaucaaguccuggcggaacaacauccugcgcacccaggagagcgagugcgccugcgucaacggcuccugcuucacggugaugaccgacgggccgagcaacggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggagcggguucgagaugaucugggacccgaacggcuggaccgggaccgacuccagcuucagcgugaagcaggacaucgucgccaucacggacugguccggcuacagcggguccuucgugcagcaccccgagcugaccggccucgacugcauccgccccugcuucugggucgagcugauccggggccgccccaaggagagcaccaucuggaccuccgggagcuccaucagcuucugcggcgugaacuccgacacggugagcugguccuggccggacggggccgagcugcccuucaccaucgacaaguga

SEQ ID NO: 87185 - RNA, 1350 nt, Artificial Sequence; identical to SEQ ID NO: 76016
  derived and/or modified sequence opt1 from neuraminidase__InfluenzaA__BAM85821

SEQ ID NO: 87186 - RNA, 1350 nt, Artificial Sequence
  derived and/or modified sequence opt1 from neuraminidase__InfluenzaA__BAM85822
augaaccccaaccagaagaucaucaccaucggcagcaucugcauggugaccgggaucgucucccugaugcuccagaucggcaacaugaucagcaucugggugucccacagcauccacacggggaaccagcaccaguccgagccgaucagcaacaccaacuuccugaccgagaaggccguggccuccgucaagcuggcgggcaacagcucccucugccccaucaacgggugggccguguacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgccuggagcgcguccgccugccacgacggcaccagcuggcucacgaucgggaucuccggccccgacaacggcgccguggccguggucaaguacaacgggaucaucaccgacaccaucaagagcuggcgcaacaacauccugcggacccaggaguccgagugcgcgugcgugaacggcagcugcuucacggugaugaccgacgggccguccaacagccaggccucccacaagaucuucaagauggagaagggcaaggucgucaagagcguggagcuggacgcccccaacuaccacuacgaggagugcuccugcuaccccgacgccggcgagaucacgugcgugugccgcgacaacuggcacgggagcaaccggcccuggguguccuucaaccagaaccucgaguaccagaucggcuacaucugcagcgggguguucggcgacaacccgcgccccaacgacgggaccggcuccugcggccccgucagcuccaacggggccuacggcgugaagggguucagcuucaaguacggcaacgggguguggaucggccggaccaaguccaccaacagccgcagcggcuucgagaugaucugggaccccaacggguggaccgagaccgacuccagcuucuccgucaagcaggacaucguggcgaucacggacuggagcggcuacuccgggagcuucguccagcacccggagcugaccggccuggacugcauccggcccugcuucuggguggagcucauccgcgggcggcccaaggaguccaccaucuggaccagcggcuccagcaucuccuucugcggcgugaacagcgacacggucgggugguccuggcccgacggcgccgagcugccguucaccaucgacaaguga

SEQ ID NO: 87187 - RNA, 1410 nt, Artificial Sequence
  derived and/or modified sequence opt1 from neuraminidase__InfluenzaA__BAM85823
augaaccccaaccagaagaucaccaccaucggcagcaucugcauggugaucgggaucgucucccugaugcuccagaucggcaacaucaucagcaucugggugucccacagcauccagacggggaaccagcaccaggccggcccgugcaaccaguccaucaucaccuacgagaacaacaccugggugaaccagaccuacgucaacaucagcaacacgaacuuccugaccgagaagaccguggccuccgugacccuggcggggaacagcucccucugccccaucagcggcugggccgucuacuccaaggacaacggcauccgcaucgggagcaagggcgacguguucgugauccgggagcccuucaucuccugcagccaccuggagugccgcacguucuuccugacccagggggcccuccugaacgacaagcacuccaacggcaccgucaaggaccggagcccccaccgcacccugauguccugcccggugggggaggcccccagccccuacaacucccgguucgagagcguggccuggagcgcguccgccugccacgacggcaucaacuggcucacgaucggcaucagcgggcccgacaacggcgccgucgccgugcugaaguacaacgggaucaucaccgacaccaucaaguccuggcgcaacaacauccugcggacccaggagagcgagugcgcgugcgugaacggcuccugcuucacgaucaugaccgacggcccgagcaacgggcaggccuccuacaagaucuuccgcaucgagaagggcaaggucgucaagagcguggagcucaacgcccccaacuaccacuacgaggagugcuccugcuaccccgacgccggggagaucacgugcgugugccgggacaacuggcacggcagcaaccgccccuggguguccuucaaccagaaccuggaguaccagaucggguacaucugcagcggcaucuucggcgacaacccgcggcccaacgacgggaccggcuccugcgggcccgugagccccaacggcgccuacgggaucaagggcuucuccuucaaguacggcaacggggucuggaucggccgcaccaagagcaccaacucccggagcggguucgagaugaucugggacccgaacggcuggaccgggaccgacuccaacuucagcgugaagcaggacaucguggcgaucacggacuggagcggcuacuccggcagcuucguccagcaccccgagcugaccgggcucgacugcauccgccccugcuucuggguggagcugauccggggccgccccaaggaguccaccaucuggaccagcggguccagcaucuccuucugcggcgucaacagcgacacggugggcugguccuggccggacggggccgagcugcccuucaccaucgacaaguga

SEQ ID NO: 87188 - RNA, 1350 nt, Artificial Sequence
  derived and/or modified sequence opt1 from neuraminidase__InfluenzaA__BAM85824
augaaccccaaccagaagaucaucaccaucggcagcaucugcauggugaucgggaucgucucccugcuccugcagaucggcaacaugaucagcaucuggaucucccacagcauccagaccgggaaccagcaccaggccgaguccaucagcaacacgaacccgcugaccgagaaggccguggcguccgugacccucgccggcaacagcucccugugccccauccgcgggugggccguccacagcaaggacaacuccauccggaucggcagcaagggcgacguguucgugauccgcgagcccuucaucuccugcagccaccuggagugccggaccuucuuccucacgcagggggcccugcugaacgacaagcacuccaacggcaccgucaaggaccgcagcccccaccggacccucauguccugcccggugggggaggcccccagccccuacaacucccgcuucgagagcguggcguggagcgccuccgccugccacgacggcaccagcuggcugacgaucgggaucuccggccccgacaacggcgccgucgcggugcugaaguacaacgggaucaucaccgacaccaucaagagcuggcggaacaacauccuccgcacccaggaguccgagugcgccugcgugaacggcagcugcuucacggucaugaccgacgggccguccaacggccaggccagcuacaagaucuucaagauggagaagggcaagguggugaaguccgucgagcuggacgcccccaacuaccacuacgaggagugcagcugcuaccccgacgccuccgagaucacgugcgugugccgggacaacuggcacgggagcaaccgccccuggguguccuucaaccagaaccuggaguaccagaucggcuacaucugcagcggggucuucggcgacaacccgcggcccaacgacgggaccggcuccugcggccccauguuccccaacggggcguacggcaucaagggguucagcuucaaguacggcaacgggguguggaucggccgcaccaaguccaccaacagccgguccggcuucgagaugaucugggacccgaacggguggaccggcaccgacagcagcuucuccgugaagcaggacaucgucgccaucacggacuggagcggguacuccggcagcuucgugcagcaccccgagcucaccgggcuggacugcauccgccccugcuucuggguggagcugauccggggccgccccaaggaguccaccaucuggaccagcggcuccagcaucuccuucugcggggucaacagcgacacgguguccuggagcuggccggacggcgccgagcuccccuucaccaucgacaaguga

SEQ ID NO: 87189 - RNA, 1350 nt, Artificial Sequence
  derived and/or modified sequence opt1 from neuraminidase__InfluenzaA__BAM85825
augaaccccaaccagaagaucaucaccaucggcagcaucugcauggugaucgggaucgucucccugaugcuccagaucggcaacaugaucagcaucugggugucccacagcauccagaccgggaaccagaaccagguggagccgaucaucaacacgaacuuccugaccgagaaggccgucgccuccaucacccuggcgggcaacagcucccucugccccauccgcgggugggccauccacagcaaggacaacuccauccggaucggcagcaagggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggccugguccgcgagcgccugccacgacggcaccagcuggcucacgaucgggaucuccggccccgacaacggcgccgucgccgugcugaaguacaacgggaucaucaccgacaccaucaagagcuggcggaacaacauccugcgcacccaggaguccgagugcgcgugcgugaacggcagcugcuucacggucaugaccgacgggccguccaacggccaggccagcuacaagaucuucaagauggagaagggcaaggugaucaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucucccacaacggcgccuacggggugaagggcuucagcuucaaguacgggaacggcguguggaucggccgcaccaagucccccaacagccgguccggguucgagaugaucugggacccgaacggcuggagcgagaccgacuccagcuucagcgucaagcaggacaucguggcgaucaccgacugguccggguacagcggcuccuucgugcagcaccccgagcugaccgggcucgacugcauccgccccugcuucugggucgagcugauccggggccgccccaaggagagcacgguguggaccuccggcagcuccaucagcuucugcggggucaacuccgacaccgugagcugguccuggccggacggcgccgagcugcccuucaccaucgacaaguga

SEQ ID NO: 87190 - RNA, 1350 nt, Artificial Sequence
  derived and/or modified sequence opt1 from neuraminidase__InfluenzaA__BAM85826
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagcuacaagaucuucaagauggagaagggcaagguggucaaguccguggagcucgacgcccccaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccgugucccugaacggcgcguacggggucaagggcuucagcuucaaguacgggaacggcguguggaucggccggaccaaguccaccaacagccgcuccggguucgagaugaucugggaccccaacggcuggaccgggaccgacagcagcuucuccgugaagcaggacaucgucgccaucacggacuggagcggcuacuccgggagcuucgugcagcacccggagcucaccggccuggacugcauccggcccugcuucugggucgagcugauccgcggccggcccaaggaguccaccaucuggaccagcggguccagcaucuccuucugcggcgugaacagcgacacgguguccuggagcuggcccgacggggccgagcucccguucaccaucgacaaguga

SEQ ID NO: 87191 - RNA, 1350 nt, Artificial Sequence
  derived and/or modified sequence opt1 from neuraminidase__InfluenzaA__BAM85827
augaaccccaaccagaagaucaucaccaucggcagcaucugcauggugaucggggucgugucccugaugcuccagaccggcaacaucaucagcaucugggugucccacagcauccagaaggggaaccagcaccaggccgaguccaucagcaacacgaacccgcugaccgagaaggccgucgcguccgugacccuggccggcaacagcucccucugccccauccgcgggugggccgugcacagcaaggacaacaacauccggaucggcuccaagggcgacgucuucgugauccgcgagcccuucaucagcugcucccaccuggagugccggaccuucuuccugacgcagggggcccuccugaacgacaagcacagcaacggcaccgugaaggaccgcagcccccaccggacccugaugagcugcccggucggggaggcccccucccccuacaacagccgcuucgaguccguggcguggagcgccagcgccugccacgacggcaccuccuggcucacgaucgggaucagcggccccgacaacgaggccguggcgguccugaaguacaacggcaucaucaccgacaccaucaaguccuggcggaacaacauccugcgcacccaggagagcgagugcgccugcgugaacggguccugcuucacggugaugaccgacggcccgagcaacgggcaggccuccuacaagaucuucaagauggagaagggcaaggucgugaaguccguggagcucgacgcccccaacuaccacuacgaggagugcuccugcuaccccgacgccggcgagaucacgugcgucugccgggacaacuggcacgggagcaaccgccccuggguguccuucaaccagaaccuggaguaccagaucggcuacaucugcagcgggguguucggcgacaacccgcggcccaacgacgggaccggcuccugcggccccaugagccccaacggggcguacggcgucaagggguucuccuucaaguacggcaacgggguguggaucggccgcaccaagagcaccaccucccggagcggcuucgagaugaucugggacccgaacggguggaccggcacggacuccagcuucagcgugaagcaggacaucgucgccaucaccgacugguccggguacagcggcuccuucgugcagcaccccgagcugaccgggcucgacugcauccgccccugcuucugggucgagcugauccggggccgccccaaggagagcaccaucuggacguccggcagcuccaucagcuucugcgggguggacuccgacaccgugagcugguccuggccggacggcgccgagcugcccuucaccaucgacaaguga

SEQ ID NO: 87192 - RNA, 1350 nt, Artificial Sequence
  derived and/or modified sequence opt1 from neuraminidase__InfluenzaA__BAM85828
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagcuacaagaucuucaagauggagaagggcaagguggucaaguccguggagcucgacgcccccaacuaccacuacgaggagugcagcugcuaccccgacgccggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccgugucccccaacggcgcguacggggucaagggcuucagcuucaaguacgggaacggcguguggaucggccggaccaaguccaccaacagccgcuccggguucgagaugaucugggacccgaacggcuggaccgggaccgacagcagcuucuccgugaagcaggacaucgucgccaucacggacuggagcggcuacuccgggagcuucgugcagcaccccgagcugaccggccucgacugcauccggcccugcuucugggucgagcugauccgcggccggcccaaggaguccaccaucuggaccagcggguccagcaucuccuucugcggcgugaacagcgacacgguguccuggagcuggccggacggggccgagcugcccuucaccaucgacaaguga

SEQ ID NO: 87193 - RNA, 1350 nt, Artificial Sequence
  derived and/or modified sequence opt1 from neuraminidase__InfluenzaA__BAM85829
augaaccccaaccagaagaucaucaccaucggcagcaucugcaugaucaucgggaucgugucccugaugcuccagaucggcaacaucaucagcaucugggucucccacagcauccagaccgggaaccagcaccaggccgagccgaucuccgacacgaacuuccugaccgagaaggccguggcgagcgugauccuggccggcaacuccagccucugccacaucuccgggugggccguccacagcaaggacaacuccauccgcaucggcagcaagggcgacguguucgugauccgggagcccuucaucuccugcagccaccuggagugccgcaccuucuuccugacccagggggcccuccugaacgacaagcacuccaacggcacggucaaggaccggagcccccaccgcacccugauguccugccccgugggggaggccccgagccccuacaacucccgguucgagagcguggcguggagcgccuccgccugccacgacggcaccagcuggcucaccaucgggaucuccggccccgacaacggcgccgucgcggugcugaaguacaacgggaucaucacggacaccaucaagagcuggcgcaacuacauccugcggacccaggaguccgagugcgccugcgugaacggcagcugcuucaccgucaugacggacgggcccuccaacggccaggccagcuacaagaucuucaagaucgagaagggcaagguggugaaguccgucgagcucgacgccccgaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacacgccccgcccgaacgacggcaccggcagcugcgggcccgugucccccaacggcgcguacggggugaagggcuucagcuucaaguacgggaacggcgucuggaucggccggaccaaguccaccaacagccgcuccggguucgagaugaucugggaccccaacggcuggaccgggaccgacagcagcuucuccgugaagcaggaccugguggccaucaccgacuggagcggcuacuccgggagcuucguccagcacccggagcucaccggccuggacugcauccggcccugcuucuggguggagcugauccgcggccggcccaaggaguccaccaucuggaccagcggguccagcaucuccuucugcggcgucaacagcgacacgguggggugguccuggcccgacggcgccgagcucccguucaccaucgacaaguga

SEQ ID NO: 87194 - RNA, 1413 nt, Artificial Sequence
  derived and/or modified sequence opt1 from neuraminidase__InfluenzaA__BAM85830
augaaccccaaccagaagaucaucaccaucggcagcaucugcauggccaucgggaccaucucccugauccuccagaucggcaacaucaucagcaucuggaucucccacagcauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacagcucccugugcccgauccggggcugggccaucuacagcaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcgucgcguggagcgccuccgccugccacgacggcaugggcuggcugaccaucgggaucagcggccccgacgacggggccguggcggugcucaaguacaacggcaucaucacggagaucaucaaguccuggcgcaagcagauccugcggacccaggagagcgagugcgucugcgugaacggcuccugcuucaccaucaugaccgacgggcccagcaacggcccggccuccuaccgcaucuucaagaucaagaaggggaagaucaccaagagcaucgagcuggacgcccccaacucccacuacgaggagugcagcugcuaccccgacacgggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggagcugcgaccccgucaacguggacggcgccgacggggugaagggcuucuccuaccgcuacggcaacggggucuggaucggccggaccaagagcaacuccagccgcaagggguucgagaugaucugggaccccaacggcuggaccgacacggacgggaacuuccuggugaagcaggacguggucgccaugaccgacugguccggcuacagcggcagcuucgugcagcacccggagcugaccgggcucgacugcaugcggcccugcuucuggguggagcugauccgcggccagccccgggagaagaccacgaucuggaccuccgggagcuccaucagcuucugcggcgucaacuccgacaccgugaacuggagcuggcccgacggcgcggagcugccguucaccaucgacaaguga

SEQ ID NO: 87195 - RNA, 1413 nt, Artificial Sequence
  derived and/or modified sequence opt1 from neuraminidase__InfluenzaA__BAM85831
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaucggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggccccgcgacggcgagggguccugcaacccggugacggcggacggcgccaacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucgugcagcaccccgagcucaccggccuggggugcauccgccccugcuucugggucgagcuggugcggggccucccgcgcgagaacaccaccaucuggacgagcggguccagcaucuccuucugcggcgucaacagcgacaccgccaacugguccuggcccgacggcgccgagcugcccuucaccaucgacaaguga

SEQ ID NO: 87196 - RNA, 1413 nt, Artificial Sequence; identical to SEQ ID NO: 82516
  derived and/or modified sequence opt1 from neuraminidase__InfluenzaA__BAM85832

SEQ ID NO: 87197 - RNA, 1410 nt, Artificial Sequence
  derived and/or modified sequence opt1 from neuraminidase__InfluenzaA__BAM85833
augaaccccaaccagaagaucaucaccaucggcagcacgugcauggugaucgggaucaucucccugauccuccagaucggcaacaucaucagcaucugggucucccacagcauccagaccgggaaccagaaccagccggagaccugcaaccaguccgugaucaccuacgagaacaagaccugggugaaccagacguacgucaacaucagcaacaccaaccuggugaucgagcgcgacgugaucuccgucgcccugcucggcaacagcucccugugccccaucagcgggugggccaucuacuccaaggacaacggcauccggaucggcagcaagggggacguguucgugauccgcgagcccuucaucuccugcagccaccuggagugccggaccuucuuccucacccagggcgcgcugcugaacgacaagcacuccaacgggacggucaaggaccgcagccccuaccggacccucauguccugcccggugggcgaggcccccagccccuacaacucccgcuucgagagcguggccuggagcgccuccgccugccacgacgggaucagcuggcugaccgucggcaucuccggccccgacaacggggcgguggccgugcugaaguacaacggcaucaucaccgacacggucaagagcuggcggaacaacauccuccgcacccaggaguccgagugcgccugcaucaacgggagcugcuucaccaucaugaccgacggcccguccaacggccaggccagcuacaagaucuucaagaucgagaaggggaagguggugaaguccgucgagcugaacgcgcccaacuaccacuacgaggagugcagcugcuaccccgacgccuccgagaucaugugcgugugccgggacaacuggcacggcagcaaccgccccuggguguccuucaaccggaaccuggaguaccagaucggguacaucugcagcggcgucuucggggacaacccgcgccccaacgacggcacgggcuccugcgggcccgugagcuccaacggcgccuacggggugaagggcuucagcuucaaguacgggaagggcgucuggaucggccggaccaaguccaccagcagccgcuccggguucgagaugaucugggaccccaacggcuggaccgagacggacagcuccuucagcgugaagcaggacaucgucgccaucaccgacugguccggguacagcggcuccuucgugcagcacccggagcucaccgggcuggacugcauccggcccugcuucuggguggagcugauccgcggccggcccaaggagaacaccaucuggacgagcggcuccagcaucuccuucugcggggucaacagcgacaccgugggcugguccuggcccgacggggccgagcucccguucaccaucgacaaguga

SEQ ID NO: 87198 - RNA, 1410 nt, Artificial Sequence
  derived and/or modified sequence opt1 from neuraminidase__InfluenzaA__BAM85834
augaaccccaaccagaagaucaucaccaucggcagcgugucccugaccgucgccacggugugcuuccucaugcagaucgccauccugaccaccaccgugacgcugcacuucaagcagaacgagugcagcaucccggcgaacaaccaggucaugcccugcgagcccaucgugaucgagcgcaacaucaccgagaucguguaccucaacaacaccaccaucgagaaggagaucugccugaaggccgccgaguaccggaacugguccaagccccagugccagaucacgggguucgccccguucagcaaggacaacuccauccgccugagcgccggcggggacaucugggucacccgggagcccuacguguccugcgaccccagcaagugcuaccaguucgcgcucggccaggggaccacccuggagaacaagcacuccaacggcacgauccacgaccgcaucccccaccggacccugcucaugaacgagcugggcgugccguuccaccuggggaccaagcaggucugcaucgccuggagcuccagcuccugccacgacggcaaggccuggcuccacgugugcgugaccggggacgaccgcaacgccacggcgagcuucaucuacgacggcaugcuggucgacuccaucgggagcuggucccagaacauccugcggacccaggagagcgagugcgugugcaucaacgggaccugcgccguggucaugaccgacggcuccgccagcggccgcgccgacacgcggauccucuucauccgcgagggcaagaucgugcacaucagcccccuguccgggagcgcccagcacaucgaggagugcuccugcuacccccgguaccccaucauccgcugcgugugccgggacaacuggaagggcagcaaccgcccggucaucgacaucaacauggcggacuacuccaucgacagcuccuacgugugcagcggccuggugggggacacgccccggaacgacgacuccagcuccagcuccaacugccgcgaccccaacaacgagcggggcaaccccggggucaagggcugggccuucgacaacgggaacgacguguggaugggccgcaccaucagcaaggacucccggagcggcuacgagaccuuccgcgugaucgggggcugggccaccgccaacuccaagagccagaccaaccggcaggucaucguggacaacaacaacugguccggguacagcggcaucuucagcgucgaguccaagagcugcaucaaccgcugcuucuacguggagcucauccgcgggcggccgcaggagacccgcgugugguggaccuccaacagcaucgucguguucugcggcacguccggcaccuacgggaccggcagcuggcccgacggggccaacaucaacuucaugcccaucuga

SEQ ID NO: 87199 - RNA, 1410 nt, Artificial Sequence
  derived and/or modified sequence opt1 from neuraminidase__InfluenzaA__BAM85835
augaaccccaaccagaagaucaucaccaucggcagcgugucccugaccaucgccacggucugcuuccucaugcagaucgccauccuggcgaccaccgugacccugcacuucaagcagaacgagugcagcaucccggccaacaaccaggugguccccugcgagcccaucaucaucgagcgcaacaucacggagaucguguaccucaacaacaccaccaucgagaaggagaucugcuccaaggccguggacuaccggaacuggagcaagccccagugccagaucaccggguucgccccguucuccaaggacaacagcauccgccuguccgccggcggggacaucugggucacgcgggagcccuacgugagcugcgacaccuccaagugcuaccaguucgcgcugggccaggggaccacccucgacaacaagcacagcaacggcacgauccacgaccgcaucccccaccggacccugcugaugaacgagcucggcgugcccuuccaccuggggaccaagcaggucugcaucgccugguccagcuccagcugccacgacggcaaggccuggcugcacgugugcgugaccggggacgaccgcaacgccacggcguccuucaucuacaacggcaugcucgucgacagcaucggguccuggagccagaacauccugcggacccaggaguccgagugcgugugcaucaacggcagcugcaccguggucaugaccgacggcagcgccuccgggaaggccgacacgcgcauccuguucgugaaggagggcaagaucauccacaucagcccgcucuccgggagcgcccagcacaucgaggagugcuccugcuacccccgguaccccaacgugcgcugcgucugccgggacaacuggcgcggcagcaaccggcccgugaucgacaucaacauggccgacuacuccaucgacagcuccuacgugugcagcggccuggucggggacaccccgcgcaacgacgacaacuccagcuccagcaacugccgggaccccaacaacgagcgcggcaaccccggggugaagggcugggcguucgacuccggggacgacguguggaugggccggaccaucagccgcgacucccggagcggcuacgagaccuucaaggucaucgggggcugggccacggccaacuccaagagccagaccagccgccaggugaucgucgacaacaacaacugguccggguacagcggcguguucuccguggagcacaagagcugcaucaaccggugcuucuacgucgagcugauccgcgggcgcccccaggagacccgggugugguggaccuccaacagcaucguggucuucugcggcacguccggcaccuacgggaccggcagcuggccggacggggccaacaucaacuucaugcccaucuga

SEQ ID NO: 87200 - RNA, 1410 nt, Artificial Sequence
  derived and/or modified sequence opt1 from neuraminidase__InfluenzaA__BAM85836
augaaccccaaccagaagaucaucaccaucggcagcgugucccugaccaucgccacgaucugcuuccucaugcagaucgccauccuggcgaccaccgucacccugcacuucaagcagaacgggugcagcaucccguccaacaaccagguggugcccugcgagcccaucaucgucgagcgcaacaucacggagaucguguaccucaacaacaccaccaucgagaaggagcugugccccaaggugcuggaguaccgggacuggagcaagccgcagugccagaucaccggcuucgcccccuucuccaaggacaacagcauccgccucuccgccgggggcgacaucugggucacgcgggagcccuacgugagcugcucccccgacaagugcuaccaguucgcccuggggcagggcaccacccuggacaaccgccacagcaacggcaccauccacgaccggaucccgcaccgcacgcuccugaugaacgagcugggggugcccuuccaccucggcaccaagcaggucugcaucgccugguccagcuccagcugccacgacgggcgggcguggcugcacgugugcgugaccggcgacgaccgcaacgccaccgccuccuucaucuacgacgggaugcuggucgacagcaucggcuccuggagccagaacauccuccggacgcaggaguccgagugcgugugcaucaacgggaccugcaccguggucaugaccgacggcagcgccagcggccgcgcggacacgcggauccuguucgugaaggaggggaagaucgugcacaucagcccccuguccggcuccgcccagcacaucgaggagugcagcugcuacccccgcuacccggacguccggugcgugugccgcgacaacuggaagggcuccaaccggcccaucaucgacaucaacauggccgacuacagcaucggguccagcuacgugugcuccggccucgucggggacacgccccgcaacgacgacagcuccagcaacuccaacugccgggaccccaacaacgagcgcggcaacccgggggugaagggcugggccuucgacuacggcaacgacguguggauggggcggaccaucagcaaggacucccgcagcggcuacgagaccuuccgggucaucgggggcuggaccaccgccaacuccaagagccaggugaaccgccaggucaucguggacaacuccaacuggagcggguacagcggcaucuucuccguggagggcaagagcugcaucaaccgcugcuucuacgucgagcugauccgggggcgcccccaggagacccgggugugguggaccuccaacagcaucguggucuucugcggcacguccgggaccuacggcaccgggagcuggcccgacggcgcgaacaucaacuucaugcccaucuga

SEQ ID NO: 87201 - RNA, 1410 nt, Artificial Sequence
  derived and/or modified sequence opt1 from neuraminidase__InfluenzaA__BAO79717
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagaacugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 87202 - RNA, 1413 nt, Artificial Sequence; identical to SEQ ID NO: 76067
  derived and/or modified sequence opt1 from neuraminidase__InfluenzaA__CAA33354

SEQ ID NO: 87203 - RNA, 1404 nt, Artificial Sequence
  derived and/or modified sequence opt1 from Neuraminidase__InfluenzaA__CAB95858
augaaccccaaccagaagaucaucgcccugggcagcguguccaucaccaucgccaccaucugccuccugaugcagaucgcgauccuggccacgaccaugacccuccacuucaacgagugcaccaacccgagcaacaaccaggccaugcccugcgagcccaucaucaucgagcgcaacaucacggagaucguccaccugaacaacaccaccaucgagaaggaguccugccccaagguggccgaguacaagaacuggagcaagccgcagugccagaucaccggguucgcccccuucuccaaggacaacagcauccggcuguccgcgggcggggacaucugggugacgcgcgagcccuacgucagcugcggccucgggaacugcuaccaguucgcccugggccagggcaccacccugaacaacaagcacuccaacgggaccauccacgaccggagcccccaccgcacgcuccugaugaacgagcugggcgugccguuccaccucgggaccaagcaggucugcaucgccugguccagcuccagcugccacgacggcaaggccuggcugcacgugugcgugaccggggacgaccggaacgcgaccgccuccaucaucuacgacggcaugcugacggacagcaucggcuccuggagcaagaacauccuccgcacccaggaguccgagugcgugugcaucaacgggaccugcaccgucgugaugacggacggcagcgccagcgggcgggccgacaccaagauccuguucauccgcgagggcaagaucgugcacaucagcccccuguccggcuccgcccagcacgucgaggagugcagcugcuacccccgguaccccgaggugcgcugcgugugccgggacaacuggaagggguccaaccgcccgguccucuacaucaacguggcggacuacagcguggacuccagcuacgucugcuccggccuggugggggacacgccccggaacgacgacagcuccagcuccagcaacugccgcgaccccaacaacgagcggggcgggcccggcgugaagggcugggccuucgacaacgggaacgacgucuggaugggccgcaccaucaagaaggacucccggagcggguacgagaccuuccgcguggugggcggguggaccaccgccaacuccaagagccagaucaaccggcaggucaucguggacuccgacaacuggagcggcuacagcggcaucuucuccgucgaggggaagaccugcaucaaccgcugcuucuacguggagcugauccggggccgcccgcaggagacgcgcgugugguggaccagcaacuccaucaucgucuucugcgggaccagcggcaccuacgggacgggcuccuggcccgacggcgccaacaucaacuucaugagcaucuga

SEQ ID NO: 87204 - RNA, 1404 nt, Artificial Sequence
  derived and/or modified sequence opt1 from neuraminidase__InfluenzaA__CAB95859
augaaccccaaccagaagaucaucgcccugggcagcguguccaucaccaucgccaccaucugccuccugaugcagaucgcgauccuggccacgaccaugacccuccacuucaacgagugcaccaacccgagcaacaaccaggccguccccugcgagcccaucaucaucgagcgcaacaucacggagaucgugcaccugaacaacaccaccaucgagaaggaguccugccccaagguggccgaguacaagaacuggagcaagccgcagugccagaucaccggguucgcccccuucuccaaggacaacagcauccggcuguccgcgggcggggacaucugggucacgcgcgagcccuacgugagcugcggccucgggaagugcuaccaguucgcccugggccagggcaccacccugaacaacaagcacuccaacgggaccauccacgaccggagcccccaccgcacgcuccugaugaacgagcugggcgugccguuccaccucgggaccaagcaggucugcaucgccugguccagcuccagcugccacgacggcaaggccuggcugcacgugugcgugaccggggacgaccggaacgcgaccgccuccaucaucuacgacggcaugcugacggacagcaucggcuccuggagcaagaacauccuccgcacccaggaguccgagugcgucugcaucaacgggaccugcaccguggugaugacggacggcagcgccagcgggcgggccgacaccaagauccuguucauccgcgagggcaagaucguccacaucggcccccuguccgggagcgcccagcacguggaggagugcuccugcuacccccgguaccccgaggugcgcugcgucugccgggacaacuggaagggcagcaaccgcccggugcucuacaucaacguggcggacuacuccgucgacagcuccuacgugugcagcgggcuggugggcgacacgccccggaacgacgacuccagcuccagcuccaacugccgcgaccccaacaacgagcgcgggggccccggcgucaaggggugggccuucgacaacggcaacgacguguggauggggcggaccaucaagaaggacagccgguccggcuacgagaccuuccgcguggucgggggcuggaccaccgccaacagcaagucccagaucaaccgccaggugaucgucgacagcgacaacugguccggcuacagcgggaucuucagcguggagggcaagaccugcaucaaccggugcuucuacguggagcugauccgggggcgcccgcaggagacgcgcgucugguggaccuccaacagcaucaucguguucugcggcaccuccgggaccuacggcacgggcagcuggcccgacggggccaacaucaacuucauguccaucuga

SEQ ID NO: 87205 - RNA, 1410 nt, Artificial Sequence; identical to SEQ ID NO: 75581
  derived and/or modified sequence opt1 from Neuraminidase__InfluenzaA__CAC19707

SEQ ID NO: 87206 - RNA, 1410 nt, Artificial Sequence
  derived and/or modified sequence opt1 from neuraminidase__InfluenzaA__CAD29959
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacagcaagcuccagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcuguggaccagcaacuccaucgucguguucugcggcaccagcgggaccuacggcacgggguccuggcccgacggcgccgacaucaaccucaugcccaucuga

SEQ ID NO: 87207 - RNA, 1410 nt, Artificial Sequence
  derived and/or modified sequence opt1 from neuraminidase__InfluenzaA__CAD29960
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgugcgcacccccuaccggacccuccugaugaacgagcugggcgugcccuuccaccucgggacgaagcaggucugcaucgccuggagcuccagcuccugccacgacggcaaggcguggcugcacgugugcgugaccggggacgacgagaacgccaccgccagcuucaucuacaacggccgccuggucgacuccaucgggagcugguccaagaagauccuccggacccaggagagcgagugcgugugcaucaacggcacgugcaccguggucaugaccgacggcuccgccagcgggaaggcggacaccaagauccuguucaucgaggagggcaagaucgugcacacgagcccccuguccgggagcgcccagcacguggaggagugcuccugcuacccgcgcuaccccggcguccggugcgugugccgcgacaacuggaagggcagcaaccggcccaucguggacaucaacgucaaggacuacuccaucgugagcuccuacgugugcagcgggcucgucggcgacacgccccgcaagaacgacuccagcuccagcucccacugccugaacccgaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccgccaggugaucgucgaccggggcaaccggagcggguacuccggcaucuucagcguggagggcaaguccugcaucaaccgcugcuucuacguggagcugauccgggggcgcaagcaggagaccgagguccuguggaccagcaacagcaucgugguguucugcggcaccuccgggaccuacggcacggggagcuggcccgacggcgccgacaucaaccucaugcccaucuga

SEQ ID NO: 87208 - RNA, 1410 nt, Artificial Sequence
  derived and/or modified sequence opt1 from neuraminidase__InfluenzaA__CAD29961
augaaccccaaccagaagaucaucaccaucggcagcgugucccugaccaucagcacgaucugcuucuucaugcagaucgccauccucgucaccaccgugacccugcacuucaagcaguacgagugcaacuccccgcccaacaaccaggugaugcugugcgagcccacgaucaucgagcgcaacaccaccgagaucgucuaccucaccaacacgaccaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggacgacccugaacaacggccacuccaacgacaccguccacgaccgcaccccguaccggacgcugcucaugaacgagcugggcgugcccuuccaccuggggaccaagcaggucugcaucgccuggagcuccagcuccugccacgacggcaaggccuggcuccacgugugcgugaccggggacgacgagaacgcgaccgccagcuucaucuacaacggccgccugguggacuccaucgggagcugguccaagaagauccugcggacgcaggagagcgagugcgucugcaucaacgggaccugcaccguggugaugaccgacggcuccgccagcgggaaggccgacacgaagauccucuucaucgaggagggcaagaucguccacaccagcacccuguccgggagcgcgcagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcuggugggcgacacgccccgcaagaacgacuccagcuccagcucccacugccucgaccccaacaacgaggagggcggccacggggugaagggcugggccuucgacgacggcaacgacgucuggauggggcggaccaucagcgagaagcugcgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcucauccgggggcgcaagcaggagaccgaggugcuguggaccuccaacagcaucguggucuucugcggcacguccgggaccuacggcaccgggagcggcccggacggcgccgacaucaaccugaugcccaucuga

SEQ ID NO: 87209 - RNA, 1410 nt, Artificial Sequence; identical to SEQ ID NO: 82553
  derived and/or modified sequence opt1 from neuraminidase__InfluenzaA__CAD29962

SEQ ID NO: 87210 - RNA, 1410 nt, Artificial Sequence; identical to SEQ ID NO: 75292
  derived and/or modified sequence opt1 from neuraminidase__InfluenzaA__CAD29963

SEQ ID NO: 87211 - RNA, 1410 nt, Artificial Sequence; identical to SEQ ID NO: 75292
  derived and/or modified sequence opt1 from neuraminidase__InfluenzaA__CAD29964

SEQ ID NO: 87212 - RNA, 1410 nt, Artificial Sequence; identical to SEQ ID NO: 75292
  derived and/or modified sequence opt1 from neuraminidase__InfluenzaA__CAD29965

SEQ ID NO: 87213 - RNA, 1410 nt, Artificial Sequence; identical to SEQ ID NO: 75292
  derived and/or modified sequence opt1 from neuraminidase__InfluenzaA__CAD29966

SEQ ID NO: 87214 - RNA, 1410 nt, Artificial Sequence; identical to SEQ ID NO: 75048
  derived and/or modified sequence opt1 from neuraminidase__InfluenzaA__CAD29967

SEQ ID NO: 87215 - RNA, 1410 nt, Artificial Sequence; identical to SEQ ID NO: 75048
  derived and/or modified sequence opt1 from neuraminidase__InfluenzaA__CAD29968

SEQ ID NO: 87216 - RNA, 1410 nt, Artificial Sequence; identical to SEQ ID NO: 75581
  derived and/or modified sequence opt1 from neuraminidase__InfluenzaA__CAD29969

SEQ ID NO: 87217 - RNA, 1410 nt, Artificial Sequence
  derived and/or modified sequence opt1 from neuraminidase__InfluenzaA__CAD29970
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccggggauccggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagccacugccugaaccccaacaacgaggagggcgggcacggcgugaaggggugggccuucgacgacggcaacgacgucuggaugggccggaccaucuccgagaagcugcgcagcggguacgagaccuucaaggugaucgagggcugguccaagccgaacagcaagcuccagaucaaccggcaggucaucguggaccgcgggaaccgguccggcuacagcgggaucuucuccguggagggcaagagcugcaucaaccgcugcuucuacgucgagcugauccggggccgcaagcaggagaccgaggugugguggacgagcaacuccaucguggucuucugcgggaccagcggcaccuacgggaccggcuccuggcccgacggggccgacaucaaccugaugcccaucuga

SEQ ID NO: 87218 - RNA, 1410 nt, Artificial Sequence; identical to SEQ ID NO: 77563
  derived and/or modified sequence opt1 from neuraminidase__InfluenzaA__CAD29971

SEQ ID NO: 87219 - RNA, 1410 nt, Artificial Sequence
  derived and/or modified sequence opt1 from neuraminidase__InfluenzaA__CAD29972
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccagcuccagcugccacgacggcaaggccuggcugcacgugugcgugaccggggacgacaagaacgcgaccgccuccuucaucuacaacggccgccuggucgacagcaucggguccuggagcaagaagauccuccggacccaggaguccgagugcgugugcaucaacggcacgugcgccguggucaugaccgacggcagcgccuccgggaaggcggacaccaagauccuguucaucgaggagggcaagaucgggcacaccagccugcucagcggcuccgcccagcacguggaggagugcagcugcuacccccgcuaccccggcgugcggugcgucugccgcgacaacuggaagggguccaaccggccgaucguggacaucaacgugaaggacuacagcaucgucuccagcuacgugugcuccggccuggugggggacacgccccgcaagaacgacagcuccagcuccagccacugccuggaccccaacaacgaggagggcgggcacggcgucaagggcugggccuucgacgacgggaacgacguguggaugggccggaccaucuccgagaagcuccgcagcggguacgagaccuucaaggucaucgagggcugguccaagcccaacagcaagcugcagaucaaccgccaggugaucguggaccgggggaaccgguccggcuacagcggcaucuucuccgucgagggcaagagcugcaucaaccgcugcuucuacguggagcugauccgggggcgcaaccaggagaccgagauccucuggacgagcaacuccaucguggucuucugcgggaccagcggcaccuacgggaccggcuccuggccggacggcgccgacaucaaccugaugcccaucuga

SEQ ID NO: 87220 - RNA, 1410 nt, Artificial Sequence
  derived and/or modified sequence opt1 from neuraminidase__InfluenzaA__CAD29973
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaagauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacuccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggagcaagcccaacuccaagcuccagaucaaccgccaggugaucguggaccgggggaaccggagcggcuacuccggcaucuucagcgucgagggcaagagcugcaucaaccgcugcuucuacguggagcugauccgggggcgcaagcaggagaccgaggugugguggacguccaacagcaucgucguguucugcgggaccuccggcaccuacgggaccggcagcuggccggacggcgccgacaucaaccugaugcccaucuga

SEQ ID NO: 87221 - RNA, 1410 nt, Artificial Sequence; identical to SEQ ID NO: 83592
  derived and/or modified sequence opt1 from neuraminidase__InfluenzaA__CAD29974

SEQ ID NO: 87222 - RNA, 1410 nt, Artificial Sequence
  derived and/or modified sequence opt1 from neuraminidase__InfluenzaA__CAD29984
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcacuacguguccugcgaccgcgacaagugcuaccaguucgcccugggccaggggaccacgcugaacaacggccacagcaacgacaccguccacgaccggacccccuaccgcacccuccugaugaacgagcugggcgugcccuuccaccucgggacgaagcaggucugcaucgccugguccagcuccagcugccaccacggcaaggcguggcugcacgugugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucaaggagggcaagaucguccacacgagcagccuguccgggagcgcccagcacguggaggagugcuccugcuacccgcgguaccccggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccagcuccagcucccacugccuggacccgaacaacgaggagggcgggcacggggucaagggcugggccuucgacgacggcaacgacguguggauggggcgcaccaucagcgagaagcugcgguccggcuacgagaccuucaaggucaucgagggguggagcaaggccaacuccaagcuccagaucaaccgccaggugaucguggaccggggcaaccgcagcggguacuccggcaucuucagcgucgagagcaaguccugcaucaaccggugcuucuacguggagcugauccgcggccggaagcaggagaccgaggugcuguggaccagcaacuccaucgucguguucugcgggaccagcggcaccuacgggacgggcuccuggcccgacggggccgacaucaaccucaugcccaucuga

SEQ ID NO: 87223 - RNA, 1410 nt, Artificial Sequence
  derived and/or modified sequence opt1 from neuraminidase__InfluenzaA__CAD29985
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccucccggaccuacgggacgggcagcuggccggacggggccgacaucaaccugaugcccaucuga

SEQ ID NO: 87224 - RNA, 1410 nt, Artificial Sequence
  derived and/or modified sequence opt1 from neuraminidase__InfluenzaA__CAD29988
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgagaaggcggacaccaagauccuguucaucgaggaggggaagaucguccacaucagcacgcugagcggcuccgcccagcacguggaggagugcagcugcuacccccgguaccccggggugcgcugcgucugccgggacaacuggaagggcuccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccgggaucuucagcgucgagggcaaguccugcaucaaccggugcuucuacguggagcugauccgcggccggaaggaggagaccgaggugugguggaccagcaacagcaucgucguguucugcgggaccuccggcaccuacgggacgggcagcuggccggacggggccgacaucaaccugaugcccaucuga

SEQ ID NO: 87225 - RNA, 1410 nt, Artificial Sequence
  derived and/or modified sequence opt1 from neuraminidase__InfluenzaA__CAD29990
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgaagcaggucugcaucgccugguccagcuccagcugccacgacgggaaggcguggcugcacgugugcgugaccggcgacgacgagaacgccaccgccuccuucaucuacaacgggcgccugguggacagcaucggcuccuggagcaagaagauccuccggacccaggaguccgagugcgucugcaucaacggcacgugcaccguggugaugaccgacgggagcgccuccggcaaggcggacaccaagauccuguucaucgaggaggggaagaucguccacacgagccugcucagcggcuccgcccagcacguggaggagugcagcugcuacccccgcuaccccggcgugcggugcgucugccgcgacaacuggaagggguccaaccggccgaucguggacaucaacgugaaggacuacagcaucgucuccagcuacgugugcuccggccuggugggggacacgccccgcaagaacgacaacagcuccagcucccacugccuggaccccaacaacgaggagggcgggcacggcgucaagggcugggccuucgacgacgggaacgacguguggaugggccggaccaucagcgagaagcuccgcuccggguacgagaccuucaaggucaucgagggcuggagcaagcccaacuccaagcugcagaucaaccgccaggugaucguggaccgggggaaccggagcggcuacuccggcaucuucagcgucgaggggaaguccugcaucaaccgcugcuucuacguggagcugauccggggccgcaagcaggagaccgaggugcucuggaccagcaacagcaucgucguguucugcgggaccuccggcaccuacgggacgggcagcuggccggacggcgccgacaucaaccugaugcccaucuga

SEQ ID NO: 87226 - RNA, 1410 nt, Artificial Sequence; identical to SEQ ID NO: 75069
  derived and/or modified sequence opt1 from neuraminidase__InfluenzaA__CAD29991

SEQ ID NO: 87227 - RNA, 1410 nt, Artificial Sequence
  derived and/or modified sequence opt1 from neuraminidase__InfluenzaA__CAD29992
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagccugcucagcggguccgcccagcacguggaggagugcagcugcuacccccgcuaccccggcgugcggugcgucugccgcgacaacuggaagggcuccaaccggccgaucguggacaucaacgugaaggaccgcagcaucgucuccagcuacgugugcuccgggcuggugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcuccggagcggcuacgagaccuucaaggucaucgaggggugguccaagcccaacagcaagcugcagaucaaccgccaggugaucguggaccggggcaaccgcuccggguacagcggcaucuucuccgucgagggcaagagcugcaucaaccggugcuucuacguggagcugauccgcgggcggaagcaggagaccgaggugcucuggaccagcaacuccaucgucguguucugcggcaccagcgggaccuacggcacgggguccuggccggacggcgccgacaucaaccugaugcccaucuga

SEQ ID NO: 87228 - RNA, 1410 nt, Artificial Sequence
  derived and/or modified sequence opt1 from neuraminidase__InfluenzaA__CAD29993
augaaccccaaccagaagaucaucaccaucggcagcgugucccugaccaucgccacgaccugcuuccucaugcagaucgccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacgcaggaguccgagugcgucugcaucaacgggaccugcaccguggugaugaccgacggcagcgccuccgggaaggcggacacgaagauccuguucaucgaggagggcaagaucguccacaccagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcggccacggggucaagggcugggccuucgacgacggcaacgacguguggauggggcggaccaucuccgagaagcugcgcagcggcuacgagaccuucaaggucaucgaggggugguccaagccgaacagcaagcuccagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcuguggaccagcaacuccaucgucguguucugcggcaccagcgggacguacggcaccggguccuggcccgacggcgccgacaucaaccucaugcccaucuga

SEQ ID NO: 87229 - RNA, 1410 nt, Artificial Sequence; identical to SEQ ID NO: 76757
  derived and/or modified sequence opt1 from neuraminidase__InfluenzaA__CAD29994

SEQ ID NO: 87230 - RNA, 1413 nt, Artificial Sequence; identical to SEQ ID NO: 77461
  derived and/or modified sequence opt1 from neuraminidase__InfluenzaA__CAD57252

SEQ ID NO: 87231 - RNA, 1413 nt, Artificial Sequence
  derived and/or modified sequence opt1 from neuraminidase__InfluenzaA__CAD57253
augaaccccaaccagaagaucaucaccaucggcagcauccgcaucgccaucgggaucaucucccugaugcuccagaucggcaacaucaucagcaucugggccucccacagcauccagaccgggucccagaaccacacgggcgugugcaaccagcggaucaucaccuacgagaacagcaccugggucaaccacaccuacgugaacaucaacaacacgaacgugaucgcggggaaggacaagaccuccgucacccuggccggcaacagcucccugugcagcaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcagauccugcggacccaggaguccgagugcgugugcgugaacggcagcugcuucaccaucaugacggacgggcccuccaacggcgccgccagcuacaagaucuucaagaucgagaaggggaagaucaccaaguccaucgagcucaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcgaggggagcugcaacccggugacgguggacggcgcgaacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacugguccggguacagcggcagcuucgugcagcaccccgagcucaccggccuggacugcauccgccccugcuucugggucgagcuggugcgggggcucccgaaggagaacaccaccaucuggacguccggcagcuccaucagcuucugcggggucaacuccgacaccgccaacuggagcuggcccgacggcgccgagcugcccuucaccaucgacaaguga

SEQ ID NO: 87232 - RNA, 1413 nt, Artificial Sequence; identical to SEQ ID NO: 75404
  derived and/or modified sequence opt1 from neuraminidase__InfluenzaA__CAD57255

SEQ ID NO: 87233 - RNA, 1413 nt, Artificial Sequence
  derived and/or modified sequence opt1 from neuraminidase__InfluenzaA__CAD57256
augaaccccaaccagaagaucaucaccaucggcagcaucuccguggccaucgggaucaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuaccgcaucuucaagaucgagaaggggcgggugaccaagagcaucgagcucgacgcccccaacuaccacuacgaggagugcuccugcuacccggacaccggcaccgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccgccccugcuucugggucgagcuggugcgggggcgcccgcgggagaacaccaccaucuggacgagcggcuccagcaucuccuucugcggggugaacagcgacaccgccaacugguccuggcccgacggcgccgagcuccccuucaccaucgacaaguga

SEQ ID NO: 87234 - RNA, 1413 nt, Artificial Sequence
  derived and/or modified sequence opt1 from neuraminidase__InfluenzaA__CAD57257
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggucgacggcgcggacggggugaagggcuucuccuaccgguacggcaacgggguguggaucggccgcaccaagagcaaccggcugcgcaagggguucgagaugaucugggaccccaacggcuggaccgacaccgacuccgacuucagcaugaagcaggacgucguggccaugacggacuggagcggguacuccggcagcuucgugcagcaccccgagcucaccggccuggacugcauccggcccugcuucugggucgagcuggugcgcgggcggccgcgcgagaacaccaccaucuggacguccggcagcuccaucagcuucugcggggucaacuccgacaccgccaacuggagcuggcccgacggcgccgagcuccccuucaccaucgacaaguga

SEQ ID NO: 87235 - RNA, 1413 nt, Artificial Sequence
  derived and/or modified sequence opt1 from neuraminidase__InfluenzaA__CAD57258
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagcgcaucaucaccuacgagaacuccaccugggucaaccagaccuacgugaacaucaacaacacgaacguggucgcggggaaggacaagaccagcauggugcuggccggcaacuccagccugugcccgauccggggcugggccaucuacaccaaggacaacuccauccgcaucgggagcaagggcgacaucuucgugauccgggagcccuucaucuccugcagccaccucgagugccgcaccuucuuccugacgcagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucaccgagacgaucaaguccuggaagaagcagauccuccgcacccaggagagcgagugcgugugcgugaacggcuccugcuucaccaucaugaccgacgggcccagcaaccgggccgccuccuaccgcaucuucaagaucgagaagggccgggucaccaagagcaucgagcuggacgccccgaacuaccacuacgaggagugcuccugcuaccccgacacggggaccgugaugugcgugugccgcgacaacuggcacggcagcaaccggcccugggucuccuucaaccagaaccuggacuaccagaucggguacaucugcagcggcguguucggcgacaacccccgcccgaaggacggggagggcuccugcaaccccgugaccgucgacggggcggacggcgugaagggguucagcuaccgguacggcaacggcguguggaucgggcgcacgaaguccaaccggcuccgcaagggcuucgagaugaucugggaccccaacggguggaccgacaccgacagcgacuucuccaugaagcaggacgucguggccaugaccgacuggagcggcuacuccgggagcuucgugcagcaccccgagcugacgggccuggacugcaugcggccgugcuucugggucgagcucgugcgcggccugccccgggagaacaccaccaucuggaccagcggguccagcaucuccuucugcggcgucaacagcgagacggccaacugguccuggcccgacggggccgagcugcccuucaccaucgacaaguga

SEQ ID NO: 87236 - RNA, 1413 nt, Artificial Sequence
  derived and/or modified sequence opt1 from neuraminidase__InfluenzaA__CAD57259
augaaccccaaccagaagaucaucaccaucggcagcaucuccaucgccaucgggaucaucagccugauccuccagaucggcaacaucaucuccaucugggccagccacuccauccagaccgagagccagaaccacacggggaucugcaaccagcgcaucaucaccuacgagaacuccaccugggugaaccagaccuacgucaacaucaacaacacgaacguggcggccggcaaggacaagaccagcaugacccuggccgggaacuccagccugugcccgauccggggcugggccaucuacaccaaggacaacuccauccgcaucggcagcaagggggacaucuucgugauccgggagcccuucaucuccugcagccaccucgagugccgcacguucuuccugacccagggcgcccugcucaacgacaagcacuccaacgggaccgucaaggaccggagccccuaccgcgcgcugauguccugcccccugggcgaggccccgagccccuacaacucccgguucgagagcguggccuggagcgccuccgcgugccacgacgggcucggcuggcugaccaucggcaucagcgggcccgacaacggcgccguggccguccugaaguacaacgggaucaucacggagaccaucaaguccuggaagaagcgcauccuccggacccaggagagcgagugcgugugcaugaacggcuccugcuucaccaucaugacggacggccccagcaacggggccgccuccuaccgcaucuucaagaucgagaagggccgggugaccaagagcaucgagcuggacgcgccgaacuaccacuacgaggagugcuccugcuaccccgagaccgggaccgucaugugcgugugccgcgacaacuggcacggcagcaaccggcccuggguguccuucaaccagaaccuggacuaccagaucggguacaucugcagcggcgucuucggcgacaacccccgcccgaaggacggggagggcuccugcaaccccgugacgguggacggggccgacggcgucaagggguucagcuaccgguacggcaacggcguguggaucgggcgcaccaaguccaaccggcuccgcaagggcuucgagaugaucugggaccccaacggguggaccgacaccgacagcgacuucuccaugaagcaggacaucguggccaugacggacuggagcggcuacuccgggagcuucguccagcaccccgagcugaccggccuggacugcaugcggccgugcuucuggguggagcucgugcgcggccugccccgggagaacaccaccaucuggacgagcggguccagcaucuccuucugcggcgucaacagcgacaccgccaacugguccuggcccgacggggccgagcugcccuucaccaucgacaaguga

SEQ ID NO: 87237 - RNA, 1413 nt, Artificial Sequence
  derived and/or modified sequence opt1 from neuraminidase__InfluenzaA__CAD57264
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcagauccuccgcacccaggagagcgagugcgugugcgugaacggcuccugcuucaccaucaugacggacgggcccagcaacggcgccgccuccuaccggaucuucaagaucgagaaggggcgcgucaccaagagcaucgagcuggacgccccgaacuaccacuacgaggagugcuccugcuaccccgacaccggcaccgugaugugcgugugccgggacaacuggcacgggagcaaccgccccugggucuccuucaaccagaaccuggacuaccagaucggcuacaucugcagcggcguguucggggacaacccccggccgaaggacggcgagggguccugcaaccccgugacggucgacggcgcgaacggggugaagggcuucagcuaccgcuacggcaacgggguguggaucggccggaccaaguccaaccgccuccggaagggguucgagaugaucugggaccccaacggcuggaccgacaccgacagcgacuucuccaugaagcaggacgucguggccaugacggacuggagcggguacuccggcagcuucgugcagcaccccgagcugaccggccuggacugcaugcgcccgugcuucugggucgagcucgugcgggggcugccccgcgagaacaccaccaucuggacgagcggcuccagcaucuccuucugcggggucaacagcgagaccgccaacugguccuggcccgacggcgccgagcugcccuucaccaucgacaaguga

SEQ ID NO: 87238 - RNA, 1350 nt, Artificial Sequence
  derived and/or modified sequence opt1 from neuraminidase__InfluenzaA__CBW54819
augaaccccaaccagaagaucaucaccaucggcagcaucugcauggugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaucagcuggcucaccaucgggaucuccggccccgacaacggcgccguggcggugcugaaguacaacgggaucaucacggacaccaucaagagcuggcggaacaacauccugcgcacccaggaguccgagugcgccugcgucaacggcagcugcuucaccgugaugacggacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccugggucuccuucaaccagaaccuggaguaccggaucggguacaucugcagcggcguguucggggacaacccgcgccccaacgacggcaccggcuccugcgggcccgugagccccaacggcgcguacggggucaagggcuucuccuucaaguacggggacggcguguggaucggccggaccaagagcaccaacucccgcagcggguucgagauggugugggacccgaacggcuggaccgggaccgacagcuccuucagcgucaagcaggacaucguggccaucaccgacugguccggcuacagcggguccuucguccagcaccccgagcugacgggccucgacugcauccggcccugcuucuggguggagcugauccgcggccggcccaaggagagcaccaucuggaccuccgggagcuccaucagcuucugcggcgugaacuccgacaccgucagcugguccuggccggacggggccgagcugcccuucacgaucgacaaguga

SEQ ID NO: 87239 - RNA, 1350 nt, Artificial Sequence
  derived and/or modified sequence opt1 from neuraminidase__InfluenzaA__CBW54821
augaaccccaaccagaagaucaucaccaucggcagcaucugcaucgugaucgggaucgucucccugaugcuccagaucggcaacaugaucagcaucugggugucccacagcauccagaccgggaaccagugccaggccgagccgaucuccaacacgaaguuccugaccgagaaggccguggcgagcgucacccuggccggcaacuccagccucugccccaucuccgggugggccguguacagcaaggacaacuccauccgcaucggcagccggggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaucagcuggcucaccaucgggaucuccggccccgacaacggcgccguggcggugcugaaguacaacgggaucaucacggacaccaucaagagcuggcggaacaacauccugcgcacccaggaguccgagugcgccugcaucaacggcagcugcuucaccgucaugacggacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgcguacggggugaagggcuucuccuucaaguacgggaacggcgucuggaucggccgcaccaagagcaccaacucccggagcggguucgagaugaucugggacccgaacggcuggaccgggaccgacagcuccuucagcgugaagcaggacaucguggccaucaccgacugguccggcuacagcggguccuucguccagcaccccgagcugacgggccucgacugcauccgccccugcuucuggguggagcugauccggggccagcccaaggagagcaccaucuggaccuccgggagcuccaucagcuucugcggcgucaacuccgacaccgugagcugguccuggccggacggggccgagcugcccuucacgaucgacaaguga

SEQ ID NO: 87240 - RNA, 1410 nt, Artificial Sequence
  derived and/or modified sequence opt1 from neuraminidase__InfluenzaA__CCG47912
augaaccccaaccagaagaucaucaccaucggcagcgugucccugaccaucgccacgaugugccucuucaugcagaucgccauccugaucaccaccgucacccugcacuucaagcaguacgagugcgacagcccggcgaacaaccaggugaugcccugcgagcccaucaucaucgagaagaacaucacgaagaucguguaccucaccaacaccaccaucgagaaggaggucugccccaagcugggggaguaccgcaacugguccaagccgcagugccggaucacgggcuucgcccccuucagcaaggacaacuccauccgccugagcgccgggggcgccaucugggugacccgggagcccuacguguccugcgaccccaacaagugcuaccaguucgcccucgggcagggcaccacccuggacaaccgccacagcaacgacacgauccacgaccggaccccguaccgcacccugcucaugaacgagcugggcguccccuuccaccuggggacccgccaggugugcaucgcgugguccagcuccagcugccacgacggcaaggccuggcuccacgugugcgucacggggcacgacaagaacgccaccgccuccuucaucuacgacggcaagcugguggacagcaucuccagcuggucccagaacauccugcggacccaggagagcgagugcgugugcaucaacgggaucugcaccgucgugaugacggacggcuccgcgagcggcaaggccgacaccaagauccucuucaucgaggaggggaaggugauccacaucagcccccugcugggcuccgcccagcacgucgaggagugcagcugcuacccccgguacccggacgugcgcugcaucugccgggacaacuggaagggguccaaccgccccaucguggacauccggaugaaggacuacagcaucggcuccagcuacaugugcuccggccucgucggggacacgccccgcaacaacgacggcagcuccaacagcaacugccggaaccccaacaacgagcgcgggaaccacggcgugaaggggugggccuucgacgacggcaacgacaucuggaugggccggaccaucuccaaggacagccgccugggguacgagaccuucaagguggucggcggguggucccagccgaacagcaaguuccagaucaaccgccaggugaucguggacuccgacaaccggagcggcuacuccgggaucuucagcgucgagggcaaguccugcaucaaccggugcuucuacguggagcugauccgcggccgccggcaggagacccgcgucugguggaccagcaacagcaucgugguguucugcgggaccuccggcacguacgggagcggcuccuggcccgacggggccgacaucaacuucaugcccaucuga

SEQ ID NO: 87241 - RNA, 1353 nt, Artificial Sequence
  derived and/or modified sequence opt1 from neuraminidase_subtype_1__InfluenzaA__AAF74321
augaaccccaaccagaagaucaucaccaucggcagcaucugcaugguggucgggaucaucucccugaugcuccagaucggcaacaucaucagcgugugggugucccacaccauccagacguggcacccgaaccagcccgagcccugcaaccagagcaucaacuucuacaccgagcaggccgccgcguccgucacccuggccgggaacagcucccugugccccaucagcggcugggccaucuacuccaaggacaacagcauccgcaucggguccaagggcgacguguucgugauccgggagccguucaucagcugcucccaccucgagugccgcaccuucuuccugacgcagggcgcccugcucaacgacaagcacagcaacgggaccgucaaggaccggucccccuaccgcacccugaugagcugccccgugggcgaggcccccuccccguacaacagccgguucgaguccguggcguggagcgccagcgccugccacgacgggaucuccuggcugaccaucggcaucagcgggcccgacaacggcgccgucgcggugcucaaguacaacggcaucaucacggacaccaucaaguccuggcgcaacaacauccugcggacccaggagagcgagugcgccugcgugaacggguccugcuucaccgucaugacggacggccccagcaacgagcaggccuccuacaagaucuucaagaucgagaaggggcgcguggugaaguccgucgagcugaacgcccccaacuaccacuaccaggagugcuccugcuacccggacgccggcgagaucacgugcgugugccgggacaacuggcacggcagcaaccgccccuggguguccuucaaccagaaccucgaguaccagaucggguacaucugcagcggcgucuucggggacagcccccggcccaacgacggcaccgggagcugcggcccggugucccugaacggcgcguacggggugaagggcuucagcuucaaguacgggaacggcgucuggaucgggcgcaccaaguccaccagcucccggagcggcuucgagaugaucugggaccccaacggcuggaccgagaccgacagcuccuucagccugaagcaggacaucaucgccaucaccgacugguccggguacagcggcuccuucauccagcaccccgagcucacggggcugaacugcaugcgccccugcuucuggguggagcugauccggggccgcccgaaggagaagaccaucuggaccagcggguccagcaucuccuucugcggcgugaacagcgacaccgucggcugguccuggcccgacggggccgagcuccccuucacgaucgacaaguga

SEQ ID NO: 87242 - RNA, 1353 nt, Artificial Sequence
  derived and/or modified sequence opt1 from neuraminidase_subtype_1__InfluenzaA__AAF74322
augaaccccaaccagaagaucaucaccaucggcagcaucugcaugguggucgggaucaucucccugaugcuccagaucggcaacaccaucagcgugugggugucccacaucaucaagacguggcacccgaaccagcccgagcccugcaaccagagcaucaacuucuacaccgagcaggccgccgcguccgucacccuggccgggaacagcucccugugccccaucagcggcugggccaucuacuccaaggacaacagcauccgcaucggguccaagggcgacguguucgugauccgggagccguucaucagcugcucccaccucgagugccgcaccuucuuccugacgcagggcgcccugcucaacgacaagcacagcaacgggaccgucaaggaccggucccccuaccgcacccugaugagcugccccgugggcgaggcccccuccccguacaacagccgguucgaguccguggcguggagcgccagcgccugccacgacgggaucuccuggcugaccaucggcaucagcgggcccgacaacggcgccgucgcggugcucaaguacaacggcaucaucacggacaccaucaaguccuggcgcaacaacacccugcggacccaggagagcgagugcgccugcgugaacggguccugcuucacggucaugaccgacggccccagcaacgagcaggccuccuacaagaucuucaagaucgagaaggggcgcguggugaaguccgucgagcugaacgcccccaacuaccacuacgaggagugcuccugcuacccggacgccggcgagaucacgugcgugugccgggacaacuggcacggcagcaaccgccccuggguguccuucaaccagaaccucgaguaccagaucggguacaucugcagcggcgucuucggggacagcccccggcccaacgacggcaccgggagcugcggcccggugucccugaacggcgcguacggggugaagggcuucagcuucaaguacgggaacggcgucuggaucgggcgcaccaaguccaccagcucccggagcggcuucgagaugaucugggaccccaacggcuggaccgagaccgacagcuccuucagccugaagcaggacaucaucgccaucacggacugguccggguacagcggcuccuucauccagcaccccgagcucaccgggcugaacugcaugcgccccugcuucuggguggagcugauccggggccgcccgaaggagaagaccaucuggaccagcggguccagcaucuccuucugcggcgugaacagcgacacggucggcugguccuggcccgacggggccgagcuccccuucaccaucgacaaguga

SEQ ID NO: 87243 - RNA, 1353 nt, Artificial Sequence
  derived and/or modified sequence opt1 from neuraminidase_subtype_1__InfluenzaA__AAF74323
augaaccccaaccagaagaucaucaccaucggcagcaucugcaugguggucgggaucaucucccugaugcuccagaucggcaacaucaucagcguguggaucucccacaucauccagaccuggcacccgaaccagcccgagcccugcaaccagagcaucaacuucuacacggagcaggccgccgcguccgugacccuggccgggaacagcucccugugccccaucagcggcugggccaucuacuccaaggacaacagcauccgcaucggguccaagggcgacgucuucgugauccgggagccguucaucagcugcucccaccucgagugccgcaccuucuuccugacccagggcgcccugcucaacgacaagcacagcaacgggacggugaaggaccggucccccuaccgcacccugaugagcugccccgucggcgaggcccccuccccguacaacagccgguucgaguccguggcguggagcgccagcgccugccacgacgggaucuccuggcugaccaucggcaucagcgggcccgacaacgaggccguggcgguccucaaguacaacggcaucaucaccgacacgauccgcuccuggcggaacaacauccugcgcacccaggagagcgagugcgccugcgugaacggcuccugcuucaccgugaugaccgacgggcccagcaacgagcaggccuccuacaagaucuucaagaucgagaagggccgggucgugaaguccguggagcugaacgcccccaacuaccacuacgaggagugcuccugcuacccggacgccggggagaucacgugcgucugccgcgacaacuggcacggcagcaaccggcccuggguguccuucaaccagaaccucgaguaccagaucggcuacaucugcagcgggguguucggcgacagcccccgccccaacgacgggaccggcagcugcgggccggucucccugaacggcgcguacggcgugaagggguucagcuucaaguacggcaacgggguguggaucggccggaccaaguccaccagcucccgcagcggguucgagaugaucugggaccccaacggcuggacggagaccgacagcuccuucagccugaagcaggacaucaucgccgucaccgacugguccggcuacagcggguccuucauccagcaccccgagcucaccggccugaacugcaugcggcccugcuucuggguggagcugauccgcgggcggccgaaggagaagacgaucuggaccagcggcuccagcaucuccuucugcggggugaacagcgacaccgucggcugguccuggcccgacggcgccgagcuccccuucaccaucgacaaguga

SEQ ID NO: 87244 - RNA, 1353 nt, Artificial Sequence
  derived and/or modified sequence opt1 from neuraminidase_subtype_1__InfluenzaA__AAF74324
augaaccccaaccagaagaucaucaccaucggcagcaucugcaugguggucgggaucaucucccugaugcuccagaucggcaacaucaucagcgugugggugucccacaucauccagaccuggcacccgaaccagcccgagcccugcaaccagagcaucaacuucuacacggagcaggccgccgcguccgucacccuggccgggaacagcucccugugccccaucagcggcugggccaucuacuccaaggacaacagcauccgcaucggguccaagggcgacguguucgugauccgggagccguucaucagcugcucccaccucgagugccgcaccuucuuccugacccagggcgcccugcucaacgacaagcacagcaacgggacggucaaggaccggucccccuaccgcacccugaugagcugccccgugggcgaggcccccuccccguacaacagccgguucgaguccguggcguggagcgccagcgccugccacgacgggaucuccuggcugaccaucggcaucagcgggcccgacaacggcgccgucgcggugcucaaguacaacggcaucaucaccgacacgaucaaguccuggcgcaacaacauccugcggacccaggagagcgagugcgccugcgugaacggguccugcuucaccgucaugaccgacggccccagcaacgagcaggccuccuacaagaucuucaagaucgagaaggggcgcguggugaaguccgucgagcugaacgcccccaacuaccacuacgaggagugcuccugcuacccggacgccggcgagaucacgugcgugugccgggacaacuggcacggcagcaaccgccccuggguguccuucaaccagaaccucgaguaccagaucggguacaucugcagcggcgucuucggggacagcccccggcccaacgacggcaccgggagcugcggcccggugucccugaacggcgcguacggggugaagggcuucagcuucaaguacgggaacggcgucuggaucgggcgcaccaaguccaccagcucccggagcggcuucgagaugaucugggaccccaacggcuggacggagaccgacagcuccuucagccugaagcaggacaucaucgccaucaccgacugguccggguacagcggcuccuucauccagcaccccgagcucaccgggcugaacugcaugcgccccugcuucuggguggagcugauccggggccgcccgaaggagaagacgaucuggaccagcggguccagcguguccuucugcggcgucaacagcgacaccaugggcugguccuggcccgacggggccgagcuccccuucaccaucgacaaguga

SEQ ID NO: 87245 - RNA, 1353 nt, Artificial Sequence
  derived and/or modified sequence opt1 from neuraminidase_subtype_1__InfluenzaA__AAF74325
augaaccccaaccagaagaucaucaccaucggcagcaucugcaugguggucgggaucaucucccugaugcuccagaucggcaacaccaucagcgugugggugucccacaucaucaagacguggcacccgaaccagcccgagcccugcaaccagagcaucaacuucuacaccgagcaggccgccgcguccgucacccuggccgggaacagcucccugugccccaucagcggcugggccaucuacuccaaggacaacagcauccgcaucggguccaagggcgacguguucgugauccgggagccguucaucagcugcucccaccucgagugccgcaccuucuuccugacgcagggcgcccugcucaacgacaagcacagcaacgggaccgucaaggaccggucccccuaccgcacccugaugagcugccccgugggcgaggcccccuccccguacaacagccgguucgaguccguggcguggagcgccagcgccugccacgacgggaucuccuggcugaccaucggcaucagcgggcccgacaacggcgccgucgcggugcucaaguacaacggcaucaucacggacaccaucaaguccuggcgcaacaacacccugcggacccaggagagcgagugcgccugcgugaacggguccugcuucacggucaugaccgacggccccagcaacgagcaggccuccuacaagaucuucaagaucgagaaggggcgcguggugaaguccgucgagcugaacgcccccaacuaccacuacgaggagugcuccugcuacccggacgccggcgagaucacgugcgugugccgggacaacuggcacggcagcaaccgccccuggguguccuucaaccagaaccucgaguaccagaucggguacaucugcagcggcgucuucggggacagcccccggcccaacgacggcaccgggagcugcggcccggugucccugaacggcgcguacggggugaagggcuucagcuucaaguacgggaacggcgucuggaucgggcgcaccaaguccaccagcucccggagcggcuucgagaugaucugggaccccaacggcuggaccgagaccgacagcuccuucagccugaagcaggacaucaucgccaucacggacugguccggguacagcggcuccuucauccagcaccccgagcucaccgggcugaacugcaugcgccccugcuucuggguggagcugauccggggccgcccgaaggagaagaccaucuggaccagcggguccagcaucuccuucugcggcgugaacagcgacacggucggcugguccuggcccgacggggccgagcuccccuacaccaucgacaaguga

SEQ ID NO: 87246 - RNA, 1410 nt, Artificial Sequence; identical to SEQ ID NO: 77736
  derived and/or modified sequence opt1 from neuraminidase__InfluenzaA__EPI239900

SEQ ID NO: 87247 - RNA, 1410 nt, Artificial Sequence; identical to SEQ ID NO: 78085
  derived and/or modified sequence opt1 from neuraminidase__InfluenzaA__EPI221062

SEQ ID NO: 87248 - RNA, 1410 nt, Artificial Sequence; identical to SEQ ID NO: 77736
  derived and/or modified sequence opt1 from neuraminidase__InfluenzaA__EPI534079

SEQ ID NO: 87249 - RNA, 1410 nt, Artificial Sequence; identical to SEQ ID NO: 77736
  derived and/or modified sequence opt1 from neuraminidase__InfluenzaA__AGM53851

SEQ ID NO: 87250 - RNA, 1410 nt, Artificial Sequence
  derived and/or modified sequence opt1 from neuraminidase__InfluenzaA__EPI731464
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggggcagcucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggcccguccaacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 87251 - RNA, 1410 nt, Artificial Sequence; identical to SEQ ID NO: 77736
  derived and/or modified sequence opt1 from neuraminidase__InfluenzaA__EPI696973

SEQ ID NO: 87252 - RNA, 1410 nt, Artificial Sequence
  derived and/or modified sequence opt1 from neuraminidase__InfluenzaA__EPI662593
augaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcugaccaucggcaucagcggccccgacuccggggccgucgccgugcucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcagcugcuaccccgacuccagcgagaucacgugcgugugccgggacaacuggcacggcuccaaccgccccugggugagcuucaaccagaaccuggaguaccagaugggguacaucugcuccggcgucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 87253 - RNA, 1410 nt, Artificial Sequence; identical to SEQ ID NO: 87252
  derived and/or modified sequence opt1 from neuraminidase__InfluenzaA__EPI830229

SEQ ID NO: 87254 - RNA, 1410 nt, Artificial Sequence; identical to SEQ ID NO: 84845
  derived and/or modified sequence opt1 from neuraminidase__InfluenzaA__AGU92879

SEQ ID NO: 87255 - RNA, 1410 nt, Artificial Sequence; identical to SEQ ID NO: 84844
  derived and/or modified sequence opt1 from neuraminidase__InfluenzaA__AGU92857

SEQ ID NO: 87256 - RNA, 1410 nt, Artificial Sequence; identical to SEQ ID NO: 84843
  derived and/or modified sequence opt1 from neuraminidase__InfluenzaA__AGU92846

SEQ ID NO: 87257 - RNA, 1410 nt, Artificial Sequence; identical to SEQ ID NO: 84854
  derived and/or modified sequence opt1 from neuraminidase__InfluenzaA__AGU92835

SEQ ID NO: 87258 - RNA, 1410 nt, Artificial Sequence; identical to SEQ ID NO: 84830
  derived and/or modified sequence opt1 from neuraminidase__InfluenzaA__AGU92703

SEQ ID NO: 87259 - RNA, 1410 nt, Artificial Sequence
  derived and/or modified sequence opt1 from neuraminidase__InfluenzaA__EPI643117
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcaucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaccaaccgccaggucaucguggaccgcggggaccgguccggcuacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucuga

SEQ ID NO: 87260 - RNA, 1410 nt, Artificial Sequence
  derived and/or modified sequence opt1 from neuraminidase__InfluenzaA__EPI675797
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggacauccugcgcacccaggagagcgagugcaucugcaucaacgggaccugcacgguggugaugaccgacggcuccgccagcggcaaggccgacaccaagauccuguucaucgaggaggggaagaucguccacaccagcacgcucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagacguucaaggugaucgagggcugguccaaccccaagagcaagcugcagaccaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 87261 - RNA, 1410 nt, Artificial Sequence; identical to SEQ ID NO: 87259
  derived and/or modified sequence opt1 from neuraminidase__InfluenzaA__EPI578429

SEQ ID NO: 87262 - RNA, 1410 nt, Artificial Sequence; identical to SEQ ID NO: 87259
  derived and/or modified sequence opt1 from neuraminidase__InfluenzaA__EPI614405

SEQ ID NO: 87263 - RNA, 1350 nt, Artificial Sequence; identical to SEQ ID NO: 87181
  derived and/or modified sequence opt1 from neuraminidase__InfluenzaA__AAT73329

SEQ ID NO: 87264 - RNA, 1350 nt, Artificial Sequence; identical to SEQ ID NO: 87181
  derived and/or modified sequence opt1 from neuraminidase__InfluenzaA__AAW80723

SEQ ID NO: 87265 - RNA, 1350 nt, Artificial Sequence; identical to SEQ ID NO: 87181
  derived and/or modified sequence opt1 from neuraminidase__InfluenzaA__EF541467

SEQ ID NO: 87266 - RNA, 1398 nt, Artificial Sequence; identical to SEQ ID NO: 84462
  derived and/or modified sequence opt1 from neuraminidase__InfluenzaA__EPI439509

SEQ ID NO: 87267 - RNA, 1410 nt, Artificial Sequence
  derived and/or modified sequence opt1 from neuraminidase__InfluenzaA__EPI482776
augaacaccaaccagcgcaucaucaccaucggcacggugugcaugaucgucgggaucaucagccugcuccugcagaucggcaacaucgugucccuguggaucagccacuccauccagaccgggugggagaaccacaccgugaugugcaaccagagcgucaucaccuacgugaacaacacgugggugaaccggaccuacgucaacaucuccaacaucaagaucgccaccauccaggacgugaccagcaucauccucgccggcaacuccagccugugccccguguccgggugggcggucuacagcaaggacaacuccauccgcaucggcagcaagggcgacaucuucgugauccgggagccguucaucuccugcagccagcuggagugccgcacguucuuccucacccagggggcccugcugaacgacaagcacuccaacggcaccgugaaggaccggagccccuaccgcacccucauguccugccccaucggggaggcccccagcccguacaacucccgguucgagagcgucgccuggagcgccuccgcgugccacgacggcaugggguggcugacgaucggcaucagcggccccgacaacggggccguggccgugcugaaguacaacggcaucaucaccgacaccaucaaguccuggcgcaacaagauccuccggacccaggagagcgagugcgucugcaugaacggguccugcuucacggugcugaccgacggccccagcaacggccaggccuccuacaagaucuucaagguggagaaggggaagaucaucaagagcaucgagcuggacgcgcccaacuaccacuacgaggagugcuccugcuacccggacaccggcaaggucaugugcgugugccgcgacaacuggcacgccagcaaccggcccuggguguccuucaaccagaaccucgacuaccagaucggguacaucugcagcggcgucuucggggacaacccccgcuccaacgacggcaagggcaacugcgggcccgugcugagcaacggcgccaacggggugaagggcuucuccuaccgguacgggaacggcgucuggaucggccgcaccaagagcaucaacucccggagcggguucgagaugaucugggacccgaacggcuggacggagaccgacuccagcuucagcaugaagcaggacaucaucgcccugaacgacugguccggguacagcggcuccuucgugcagcaccccgagcucaccgggaugaacugcauccgccccugcuucugggucgagcugauccggggccagcccaaggagagcaccaucugggccuccggcagcuccaucagcuucugcggggugaacuccgagacggcgagcugguccuggccggacggcgccgaccugcccuucaccaucgacaaguga

SEQ ID NO: 87268 - RNA, 1410 nt, Artificial Sequence
  derived and/or modified sequence opt1 from neuraminidase__InfluenzaA__EPI745533
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcaucaagcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 87269 - RNA, 1410 nt, Artificial Sequence; identical to SEQ ID NO: 77736
  derived and/or modified sequence opt1 from neuraminidase__InfluenzaA__AEE69012

SEQ ID NO: 87270 - RNA, 1410 nt, Artificial Sequence; identical to SEQ ID NO: 77736
  derived and/or modified sequence opt1 from neuraminidase__InfluenzaA__EPI176609

SEQ ID NO: 87271 - RNA, 1410 nt, Artificial Sequence; identical to SEQ ID NO: 77736
  derived and/or modified sequence opt1 from neuraminidase__InfluenzaA__EPI176472

SEQ ID NO: 87272 - RNA, 1410 nt, Artificial Sequence
  derived and/or modified sequence opt1 from neuraminidase__InfluenzaA__EPI280340
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaucaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 87273 - RNA, 1410 nt, Artificial Sequence; identical to SEQ ID NO: 77736
  derived and/or modified sequence opt1 from neuraminidase__InfluenzaA__EPI240318

SEQ ID NO: 87274 - RNA, 1410 nt, Artificial Sequence; identical to SEQ ID NO: 77736
  derived and/or modified sequence opt1 from neuraminidase__InfluenzaA__EPI183133

SEQ ID NO: 87275 - RNA, 1410 nt, Artificial Sequence; identical to SEQ ID NO: 77736
  derived and/or modified sequence opt1 from neuraminidase__InfluenzaA__EPI369141

SEQ ID NO: 87276 - RNA, 1410 nt, Artificial Sequence
  derived and/or modified sequence opt1 from neuraminidase__InfluenzaA__EPI482787
augaacaccaaccagcgcaucaucaccaucggcacggugugccugaucgucgggaucgugagccuccugcugcagaucggcaacaucgugucccucuggaucagccacuccauccagaccgggaagcggagccaccccgagaccugcucccagaacgucaucaccuacgagaacaacacgugggugaaccagaccuacgugaacaucagcaacaccaacaucgucgacggccagggggugaccuccaucauccuggccggcaacagcccgcugugccccaucuccggcugggccaucuacagcaaggacaacuccauccgcaucgggagcaagggcgacaucuucgugauccgggagcccuucaucuccugcagccaccucgagugccgcacguucuuccugacccagggggcgcugcucaacgaccggcacuccaacggcaccgucaaggaccgcagccccuaccggacccugauguccugcccgaucggggaggcccccagccccuacaacucccgcuucgagagcguggccuggagcgccuccgccugccacgacggcaugggcuggcugacgaucgggaucagcggccccgacaacggggcgguggccguccucaaguacaacggcaucaucaccgacaccaucaaguccuggcggaacaagauccugcgcacccaggagagcgagugcgugugcaucaacggcuccugcuucacgaucaugaccgacgggccgagcaacggccaggccuccuacaagaucuucaagauggagaaggggaagaucaucaagagcguggagcuggacgcccccaacuaccacuacgaggagugcuccugcuaccccgacaccggcaaggucgugugcgugugccgggacaacuggcacgcgagcaaccgccccugggucaccuucgaccagaaccucaacuaccagaucggguacaucugcuccggcguguucggcgacaacccgcggagcaacgacgggaagggcaacugcgggcccgugcccuccaacggcgccaacggggucaagggcuucagcuuccgcuacggcaacgggguguggaucggccggacgaaguccaucagcucccgcagcggguucgagaugaucugggaccccaacggcuggaccgagaccgacuccagcuucagcaucaagcaggacaucaucgcccugaccgacugguccggguacagcggcuccuucgugcagcacccggagcugacgggcaugaacugcaucaagcccugcuucugggucgagcucauccgggggcagcccaaggagagcaccaucuggaccuccggcagcuccaucagcuucugcgggguggacuccgagaccgucagcugguccuggcccgacggcgccgaccugccguucacgaucgacaaguga

SEQ ID NO: 87277 - RNA, 1410 nt, Artificial Sequence
  derived and/or modified sequence opt1 from neuraminidase__InfluenzaA__EPI482790
augaacaccaaccagcgcaucaucaccaucggcacggugugccugaucgucgggaucaucagccuccugcugcagaucggcaacauggugucccucuggaucagccacuccauccagaccgggggcaagaaccacaccgagaugugcaaccagaacgugaucaccuacgucaacaacacgugggugaaccggaccuacgugaacaucagcaacaccaagaucgucaacgugcaggacguggucuccgugauccugaccgggaacagcucccugugccccaucagcggcugggccaucuacuccaaggacaacagcauccgcaucggcuccaagggggacaucuucgugauccgggagccguucaucagcugcucccaccucgagugccgcacguucuuccugacccagggcgcccugcucaacgacaagcacagcaacgggaccgucaaggaccggucccccuaccgcacccugaugagcugccccgugggcgaggcgcccuccccguacaacagccgguucgaguccguggccuggagcgccagcgccugccacgacgggaugggcuggcugacgaucggcaucuccgggcccgacaacggcgccgucgcggugcucaaguacaacgggaucaucaccgacaccaucaagagcuggcgcaacaagauccugcggacccaggaguccgagugcgugugcaugaacggcagcugcuucacgguccugaccgacggccccuccaacgggcaggccagcuacaagaucuucaagauggagaagggcaagaucaucaaguccaucgagcucgacgcccccaacuaccacuacgaggagugcagcugcuacccggacgccgggaaggugaugugcgugugccgcgacaacuggcacgcguccaaccggcccugggucagcuucgaccagaaccuggacuaccagaucggcuacaucugcuccgggguguucggcgacaacccccgcagcaacgacggcaaggggaacugcggccccgugcacuccaacggggccaacggcgucaagggguucagcuaccgguacggcaacggcguguggaucgggcgcaccaaguccaucaacagccgguccggcuucgagaugaucugggacccgaacggguggaccggcacggacagcuccuucagcaugaagcaggacaucaucgcccugaccgacuggagcggguacuccggcagcuucguccagcaccccgagcucaccggcaugaacugcauccgccccugcuucuggguggagcugauccgggggcagcccaaggagaacaccaucugggccuccggcagcuccaucagcuucugcggggugaacggcgagacggccuccuggagcuggccggacggcgcggaccugcccuucaccaucgacaaguga

SEQ ID NO: 87278 - RNA, 1410 nt, Artificial Sequence
  derived and/or modified sequence opt1 from neuraminidase__InfluenzaA__EPI291797
augaacaccaaccagcgcaucaucaccaucggcacggugugcaugaucgucgggaucaucagccugcuccugcagaucggcaacaucgugucccuguggaucagccacuccauccagaccgggugggagaaccacaccgagaugugcaaccagagcgugaucaccuacgucaacaacacgugggugaaccggaccuacgugaacaucuccaacaccaacaucgccaccauccaggacgucacgagcaucauccucgccggcaacuccagccugugccccguguccgggugggcgaucuacagcaaggacaacuccauccgcaucggcagcaagggcgacaucuucgugauccgggagccguucaucuccugcagccagcuggagugccgcaccuucuuccucacccagggggcccugcugaacgacaagcacuccaacggcaccgucaaggaccggagccccuaccgcacgcucauguccugccccaucggggaggcccccagcccguacaacucccgguucgagagcguggccuggagcgccuccgcgugccacgacggcaugggguggcugaccaucggcaucagcggccccgacaacggggccguggccguccugaaguacaacggcaucaucaccgacaccaucaaguccuggcgcaacaagauccuccggacgcaggagagcgagugcgugugcaugaacggguccugcuucaccgugcugaccgacggccccagcaacggccaggccuccuacaagaucuucaaggucgagaaggggaagaucaucaagagcaucgagcuggacgcgcccaacuaccacuacgaggagugcuccugcuacccggacaccggcaaggugaugugcgugugccgcgacaacuggcacgccagcaaccggcccugggucuccuucaaccagaaccucgacuaccagaucggguacaucugcagcggcguguucggggacaacccccgcuccaacgacggcaagggcaacugcgggcccgugcugagcaacggcgccaacggggucaagggcuucuccuaccgguacgggaacggcguguggaucggccgcaccaagagcaucaacucccggagcggguucgagaugaucugggacccgaacggcuggacggagaccgacuccagcuucagcaugaagcaggacaucaucgcccugaccgacugguccggguacagcggcuccuucgugcagcaccccgagcucacggggaugaacugcauccgccccugcuucugggucgagcugauccggggccagcccaaggagagcaccaucugggccuccggcagcuccaucagcuucugcggggugaacuccgagaccgcgagcugguccuggccggacggcgccgaccugcccuucaccaucgacaaguga

SEQ ID NO: 87279 - RNA, 1410 nt, Artificial Sequence; identical to SEQ ID NO: 87278
  derived and/or modified sequence opt1 from neuraminidase__InfluenzaA__EPI482798

SEQ ID NO: 87280 - RNA, 1410 nt, Artificial Sequence
  derived and/or modified sequence opt1 from neuraminidase__InfluenzaA__EPI638969
augaacaccaaccagcgcaucaucaccaucggcacggugugcaugaucgucgggaugaucagccugcuccugcagaucggcuccaucgugagccuguggaucucccacagcauccagaccgggugggagaaccacaccggcgugugcaaccaguccgucaucaccuacgugaacaacacgugggugaaccggaccuacgucaacaucagcaacaucaagaucgccaccauccaggacgugacccccaucauccucgccgggaacuccagccugugcccggugaacggcugggcggucuacuccaaggacaacagcauccgcaucggcuccaagggggacaucuucgugauccgggagcccuucaucagcugcucccagcuggagugccgcacguucuuccucacccagggcgcccugcugaacgacaagcacagcaacgggaccgugaaggaccggucccccuaccgcacccucaugagcugccccaucggcgaggccccgucccccuacaacagccgguucgaguccgucgccuggagcgccagcgcgugccacgacgggaugggcuggcugacgaucggcaucuccgggcccgacaacggcgccguggccgugcugaaguacaacgggaucaucaccgacaccaucaagagcuggcgcaacaagauccuccggacccaggaguccgagugcgucugcaugaacggcagcugcuucacggugcugaccgacggccccuccaacgggcaggccagcuacaagaucuucaagguggagaagggcaagaucaucaaguccaucgagcuggacgcgccgaacuaccacuacgaggagugcagcugcuaccccgacaccgggaaggucaugugcgugugccgcgacaacuggcacgccuccaaccggcccugggugagcuucaaccagaaccucgacuaccagaucggcuacaucugcuccggggucuucggcgacaacccccgcagcaccgacggcaaggggaacugcggcccggugcuguccaacggggccaacggcgugaagggguucagcuaccgguacggcaacggcgucuggaucgggcgcacgaaguccaucaacagccgguccggcuucgagaugaucugggaccccaacggguggaccgagaccgacagcuccuucagcaugaagcaggacaucaucgcccugaacgacuacagcggcuacuccgggagcuucgugcagcaccccgagcucaccggcaugaacugcauccgccccugcuucugggucgagcugauccggggccagccgaaggaguccacgaucugggccagcggguccagcaucuccuucugcggcgugaacagcgagaccgcguccuggagcuggcccgacggggccgaccugcccuucgccaucgacaaguga

SEQ ID NO: 87281 - RNA, 1410 nt, Artificial Sequence
  derived and/or modified sequence opt1 from neuraminidase__InfluenzaA__ABI19012
augaacaccaaccagcgcaucaucaccaucggcacggugugccugaucgucgggaucaucagccuccugcugcagaucggcaacauggugucccucuggaucagccacuccauccagaccgggggcaagaaccacaccgagaugugcaaccagaacgugaucaccuacgucaacaacacgugggugaaccggaccuacgugaacaucagcaacaccaagaucgucaacgugcaggacguggucuccgugauccugaccgggaacagcucccugugccccaucagcggcugggccaucuacuccaaggacaacagcauccgcaucggcuccaagggggacaucuucgugauccgggagccguucaucagcugcucccaccucgagugccgcacguucuuccugacccagggcgcccugcucaacgacaagcacagcaacgggaccgucaaggaccggucccccuaccgcacccugaugagcugccccaucggcgaggcgcccuccccguacaacagccgguucgaguccguggccuggagcgccagcgccugccacgacgggaugggcuggcugacgaucggcaucuccgggcccgacaacggcgccguggcgguccucaaguacaacgggaucaucaccgacaccaucaagagcuggcgcaacaagauccugcggacccaggaguccgagugcgugugcaugaacggcagcugcuucacggugcugaccgacggccccuccaacgggcaggccagcuacaagaucuucaagauggagaagggcaagaucaucaaguccaucgagcucgacgcccccaacuaccacuacgaggagugcagcugcuacccggacgccgggaaggucaugugcgugugccgcgacaacuggcacgcguccaaccggcccugggugagcuucgaccagaaccuggacuaccagaucggcuacaucugcuccggggucuucggcgacaacccccgcagcaacgacggcaaggggaacugcggccccgugcacuccaacggggccaacggcgugaagggguucagcuaccgguacggcaacggcgucuggaucgggcgcaccaaguccaucaacagccgguccggcuucgagaugaucugggacccgaacggguggaccggcacggacagcuccuucagcaugaagcaggacaucaucgcccugaccgacuggagcggguacuccggcagcuucgugcgccaccccgagcucaccggcaugaacugcauccggcccugcuucugggucgagcugauccgcgggcagcccaaggagaacaccaucugggccuccggcagcuccaucagcuucugcggggugaacggcgagacggccuccuggagcuggccggacggcgcggaccugcccuucaccaucgacaaguga

SEQ ID NO: 87282 - RNA, 1410 nt, Artificial Sequence
  derived and/or modified sequence opt1 from neuraminidase__InfluenzaA__EPI687791
augaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccagccugugcccggucuccgggugggccaucuacagcaaggacaacuccgugcggaucggcagcaagggcgacguguucgucauccgcgagcccuucaucuccugcagcccccucgagugccggaccuucuuccugacccagggggcccugcucaacgacaagcacuccaacggcaccaucaaggaccgcagccccuaccggacgcugauguccugcccgaucggggaggugcccagccccuacaacagccgcuucgaguccguggccuggagcgcguccgccugccacgacggcaucaacuggcugaccaucgggaucagcggccccgacuccggcgccgucgccgugcucaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgagaagggcaagaucaucaaguccgucgagaugaaggcccccaacuaccacuacgaggagugcagcugcuaccccgacuccagcgagaucacgugcgugugccgcgacaacuggcacggguccaaccggcccugggugagcuucaaccagaaccuggaguaccagaugggcuacaucugcuccggggucuucggcgacaacccgcgccccaacgacaagaccgggagcugcggccccguguccagcaacggcgccaacggggugaagggcuucagcuucaaguacgggaacggcgucuggaucgggcggaccaaguccaucagcucccgcaagggcuucgagaugaucugggaccccaacggcuggaccgggaccgacaacaaguucagcaucaagcaggacaucgugggcaucaacgagugguccggguacagcggcuccuucgugcagcacccggagcucacggggcuggacugcauccggcccugcuucugggucgagcugauccgcggccggcccgaggagaacaccaucuggaccagcggcuccagcaucuccuucugcggggugaacagcgacaccgucggcugguccuggcccgacggggccgagcucccguucacgaucgacaaguga

SEQ ID NO: 87283 - RNA, 1410 nt, Artificial Sequence
  derived and/or modified sequence opt1 from neuraminidase__InfluenzaA__EPI841266
augaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccagccugugcccggucuccgggugggccaucuacagcaaggacaacuccgugcggaucggcagcaagggcgacguguucgucauccgcgagcccuucaucuccugcagcccccucgagugccggaccuucuuccugacccagggggcccugcucaacgacaagcacuccaacggcaccaucaaggaccgcagccccuaccggacgcugauguccugcccgaucggggaggugcccagccccuacaacagccgcuucgaguccguggccuggagcgcguccgccugccacgacggcaucaacuggcugaccaucgggaucagcggccccgacuccggcgccgucgccgugcucaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgaggagggcaagaucaucaaguccgucgagaugaaggcccccaacuaccacuacgaggagugcagcugcuaccccgacuccagcgagaucacgugcgugugccgcgacaacuggcacggguccaaccggcccugggugagcuucaaccagaaccuggaguaccagaugggcuacaucugcuccggggucuucggcgacaacccgcgccccaacgacaagaccgggagcugcggccccguguccagcaacggcgccaacggggugaagggcuucagcuucaaguacgggaacggcgucuggaucgggcggaccaaguccaucagcucccgcaagggcuucgagaugaucugggaccccaacggcuggaccgggaccgacaacaaguucagcaucaagcaggacaucgugggcaucaacgagugguccggguacagcggcuccuucgugcagcacccggagcucacggggcuggacugcauccggcccugcuucugggucgagcugauccgcggccggcccgaggagaacaccaucuggaccagcggcuccagcaucuccuucugcggggugaacagcgacaccgucggcugguccuggcccgacggggccgagcucccguucacgaucgacaaguga

SEQ ID NO: 87284 - RNA, 1410 nt, Artificial Sequence
  derived and/or modified sequence opt1 from neuraminidase__InfluenzaA__EPI291844
augaacaccaaccagcgcaucaucaccaucggcacggugugccugaucgucgggaucaucagccuccugcugcagaucggcaccauggugucccucuggaucagccacuccauccagaccgggggcaagaaccacaccgagaugugcaaccagaacgugaucacguacgucaacaacaccugggugaaccggaccuacgugaacaucagcaacaccaagaucgucaacgugcaggacguggucuccgugauccugacggggaacagcucccugugccccaucagcggcugggccaucuacuccaaggacaacagcauccgcaucggcuccaagggggacaucuucgugauccgggagccguucaucagcugcucccaccucgagugccgcaccuucuuccugacccagggcgcccugcucaacgacaagcacagcaacgggaccgucaaggaccggucccccuaccgcacgcugaugagcugccccaucggcgaggcgcccuccccguacaacagccgguucgaguccguggccuggagcgccagcgccugccacgacgggaugggcuggcugaccaucggcaucuccgggcccgacaacggcgccguggcgguccucaaguacaacgggaucaucaccgacaccaucaagagcuggcgcaacaagauccugcggacgcaggaguccgagugcgugugcaugaacggcagcugcuucaccgugcugaccgacggccccuccaacgggcaggccagcuacaagaucuucaagauggagaagggcaagaucaucaaguccaucgagcucgacgcccccaacuaccacuacgaggagugcagcugcuacccggacgccgggaaggucaugugcgugugccgcgacaacuggcacgcguccaaccggcccugggugagcuucgaccagaaccuggacuaccagaucggcuacaucugcuccggggucuucggcgacaacccccgcagcaacgacggcaaggggaacugcggccccgugcacuccaacggggccaacggcgugaagggguucagcuacaaguacggcaacggcgucuggaucgggcggaccaaguccaucaacagccgcuccggcuucgagaugaucugggacccgaacggguggacgggcaccgacagcuccuucagcaugaagcaggacaucaucgcccugaccgacuggagcggguacuccggcagcuucgugcagcaccccgagcucaccggcaugaacugcauccggcccugcuucugggucgagcugauccgcgggcagcccaaggagaacacgaucugggccuccggcagcuccaucagcuucugcggggugaacggcgagaccgccuccuggagcuggccggacggcgcggaccugcccuucaccaucgacaaguga

SEQ ID NO: 87285 - RNA, 1410 nt, Artificial Sequence
  derived and/or modified sequence opt1 from neuraminidase__InfluenzaA__EPI558120
augaacaccaaccagcgcaucaucaccaucggcacggugugcaugaucgucgggaucaucagccugcuccugcagaucggcaacaucgugucccuguggaucagccacuccauccagaccgggugggagaaccacaccgagaugugcaaccagagcgugaucaccuacgucaacaacacguggaugaaccggaccuacgugaacaucuccaacaucaagaucgccaccauccaggacgugaccagcaucguccucgccggcaacuccagccugugccccguguccgggugggcgguguacagcaaggacaacuccauccgcaucggcagcaagggcgacaucuucgucauccgggagccguucaucuccugcagccagcuggagugccgcacguucuuccucacccagggggcccugcugaacgacaagcacuccaacggcaccgugaaggaccggagccccuaccgcacccucauguccugccccaucggggaggcccccagcccguacaacucccgguucgagagcguggccuggagcgccuccgcgugccacgacggcaugggguggcugacgaucggcaucagcggccccgacaacggggccgucgccgugcugaaguacaacggcaucaucaccgacaccaucaaguccuggcgcaacaagauccuccggacccaggagagcgagugcgugugcaucaacggguccugcuucacgguccugaccgacggccccagcaacggccaggccuccuacaagaucuucaagguggagaaggggaagaucaucaagagcaucgagcuggacgcgcccaacuaccacuacgaggagugcuccugcuacccggacaccggcaaggugaugugcaucugccgcgacaacuggcacgccagcaaccggcccugggucuccuucgaccagaaccucgacuaccagaucggguacaucugcagcggcguguucggggacaacccccgcuccaacgacggcaagggcaacugcgggcccgugcugagcaacggcgccaacggggucaagggcuucuccuaccgguacgggaacggcguguggaucggccgcaccaagagcaucaacucccggagcggguucgagaugaucugggacccgaacggcuggacggagaccgacuccagcuucagcaugaagcaggacaucaucgcccugaacgacugguccggguacagcggcuccuucgugcagcaccccgagcucaccgggaugaacugcauccgccccugcuucugggucgagcugauccggggccagcccaaggagagcaccaucugggccuccggcagcuccaucagcuucugcggggugaacuccgagacggcgagcugguccuggccggacggcgccgaccugcccuucaccaucgacaaguga

SEQ ID NO: 87286 - RNA, 1410 nt, Artificial Sequence
  derived and/or modified sequence opt1 from neuraminidase__InfluenzaA__EPI564138
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcaagcucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucguggagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggaccagcggcacguacgggaccggcuccuggcccgacggggccgaccugaaccugaugcccaucuga

SEQ ID NO: 87287 - RNA, 1410 nt, Artificial Sequence
  derived and/or modified sequence opt1 from neuraminidase__InfluenzaA__ANM92825
augaaccccaaccagaagaucaucaccaucggcagcaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcugaccaucggcaucagcggccccgacuccggggccgucgccgugcucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcagcugcuaccccgacuccagcgagaucacgugcgugugccgggacaacuggcacggcuccaaccgccccugggugagcuucaaccagaaccuggaguaccagaugggguacaucugcuccggcgucuucggggacaacccgcggcccaacgacaagaccggcaacugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaaguucuccaucaagcaggacaucguggggaucaacgaguggagcggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgucggguggagcuggcccgacggcgccgagcucccguucacgaucgacaaguga

SEQ ID NO: 87288 - RNA, 1410 nt, Artificial Sequence
  derived and/or modified sequence opt1 from neuraminidase__InfluenzaA__EPI291694
augaacaccaaccagcgcaucaucaccaucggcacggugugccugaucgucgggaucgugagccuccugcugcagaucggcaacaucgugucccucuggaucagccacuccauccagaccggggagaagaaccacagcgaggucugcaaccagaacaucaucaccuacgagaacaagaccugggugaaccagacguacgugaacaucuccaacaccaacaucgccgagggccagggggucaccagcaucauccuggccggcaacuccagccugugccccguguccggcugggcgaucuacagcaaggacaacuccauccggaucgggagcaagggcgacaucuucgugauccgcgagccguucaucuccugcagccaccucgagugccggaccuucuuccugacgcagggggcccugcucaacgaccgccacuccaacggcaccgucaaggaccggagccccuaccgcacccugauguccugccugaccggggaggcccccagccccuacaacucccgguucgagagcguggccuggagcgccuccgcgugccacgacggcaugggcuggcucacgaucgggaucagcggcccggacaacggggccguggccguccugaaguacaacggcaucaucaccgacaccaucaaguccuggcgcaacaagauccugcggacccaggagagcgagugcgugugcaucaacggcuccugcuucacgaucaugaccgacgggcccagcaacggccaggccuccuacaagaucuucaagauggagaaggggaagaucaucaagagcguggagcucgacgcgcccaacuaccacuacgaggagugcuccugcuaccccgacaccggcaaggucgugugcgugugccgcgacaacuggcacgccagcaaccggccgugggucuccuucgaccagaaccuggacuaccagaucggguacaucugcagcggcguguucggcgacaacccccgcuccaacgacgggaagggcaacugcgggcccgugcccagcaacggcgccaacggggucaagggcuucuccuuccgguacggcaacgggguguggaucggccgcaccaagagcaucaucucccggagcggguucgagaugaucugggacccgaacggcuggacggagaccgacuccagcuucagcaucaagcaggacaucaucgcccugaccgacugguccggguacagcggcuccuucgugcagcaccccgagcucaccggcaugaacugcauccgccccugcuucugggucgagcugauccgggggcagcccaaggagagcacgaucuggaccuccggcagcuccaucagcuucugcgggguggacuccgagaccgccagcugguccuggccggacggcgcggaccugcccuucaccaucgacaaguga

SEQ ID NO: 87289 - RNA, 1410 nt, Artificial Sequence; identical to SEQ ID NO: 78222
  derived and/or modified sequence opt1 from neuraminidase__InfluenzaA__EPI241027

SEQ ID NO: 87290 - RNA, 1410 nt, Artificial Sequence; identical to SEQ ID NO: 77746
  derived and/or modified sequence opt1 from neuraminidase__InfluenzaA__EPI177405

SEQ ID NO: 87291 - RNA, 1410 nt, Artificial Sequence; identical to SEQ ID NO: 77746
  derived and/or modified sequence opt1 from neuraminidase__InfluenzaA__EPI242475

SEQ ID NO: 87292 - RNA, 1410 nt, Artificial Sequence
  derived and/or modified sequence opt1 from neuraminidase__InfluenzaA__EPI590131
augaacgccaaccagcgcaucaucaccaucggcaccgugugccugaucaucgggaucaucagccuccugcugcagaucggcaacauggucucccucuggaucagccacuccauccagaccgggggcaagaaccacacggagaugugcaaccagaacgugaucaccuacgugaacaacaccugggucaaccggacguacgugaacaucagcaacaccaagaucgugaacguccaggacgugguguccgucauccugaccgggaacagcucccugugcagcaucuccggcugggccaucuacagcaaggacaacuccauccgcaucggcagcaagggggacaucuucgugauccgggagcccuucaucuccugcagccaccucgagugccgcaccuucuuccugacgcagggcgcgcugcucaacgacaagcacuccaacgggaccgugaaggaccggagcccguaccgcacccugauguccugccccaucggcgaggcccccagccccuacaacucccgguucgagagcgucgccuggagcgccuccgccugccacgacgggaucggcuggcugaccaucggcaucagcgggccggacaacggcgcgguggccgugcucaaguacaacgggaucaucacggacaccaucaaguccuggcgcaacaagauccugcggacccaggagagcgagugcgucugcaugaacggcuccugcuucgccgugcugaccgacggccccagcaacgggcaggccuccuacaagaucuucaaggugaagcagggcaagaucaucaagagcaucgagcucgacgcgcccaacuaccacuacgaggagugcuccugcuaccccgacgccgggaaggucaugugcgugugccgcgacaacuggcacgccagcaaccggccguggguguccuucgaccaggaccugaacuaccagaucggcuacaucugcagcggggucuucggcgacaacccccgcuccaacgacggcaaggggaacugcggccccgugcacagcaacggggccaacggcgugaagggguucuccuaccgguacggcaacggcgucuggaucgggcgcaccaagagcauccacucccggagcggcuucgagaugaucugggaccccaacggguggacgggcaccgacuccagcuucagcaugaagcaggacaucaucgcccugaccgacugguccggguacagcggcuccuucgugcagcacccggagcucacgggcaugaacugcauccgccccugcuucugggucgagcugauccgggggcagcccaaggagaacaccaucugggcgagcggcuccagcaucuccuucugcggggugaacggcgagaccgccagcugguccuggcccgacggcgccgaccugccguucaccaucgacaaguga

SEQ ID NO: 87293 - RNA, 1410 nt, Artificial Sequence
  derived and/or modified sequence opt1 from neuraminidase__InfluenzaA__EPI68596
augaacaccaaccagcgcaucaucaccaucggcacggugugccugaucgucgggaucgugagccuccugcugcagaucggcaacaucgugucccucuggaucagccacuccauccagaccggggagaagaaccacagcgagaucugcucccagaacgucaucaccuacgagaacaacaccugggugaaccagacguacgugaacaucagcaacaccaacaucgccgacggccagggggucaccuccaucauccuggccggcaacagcucccugugccccaucagcggcugggcgaucuacuccaaggacaacagcauccggaucggguccaagggcgacaucuucgugauccgcgagccguucaucagcugcucccaccucgagugccggaccuucuuccugacgcagggggcccugcucaacgaccgccacagcaacggcaccgugaaggaccggucccccuaccgcacccugaugagcugccccaucggggaggcccccuccccguacaacagccgguucgagagcgucgccugguccgccagcgcgugccacgacggcaugggcuggcugaccaucgggaucuccggccccgacaacggggccguggccgugcucaaguacaacggcaucaucacggacaccaucaagagcuggcgcaacaagauccugcggacccaggaguccgagugcgucugcaucaacggcagcugcuucaccaucaugacggacgggcccuccaacggccaggccagcuacaagaucuucaagauggagaaggggaagaucaucaaguccguggagcuggacgcgcccaacuaccacuacgaggagugcagcugcuacccggacaccggcaagguggucugcgugugccgcgacaacuggcacgccuccaaccggcccugggugagcuucgaccagaaccucgacuaccagaucggguacaucugcuccggcgucuucggcgacaacccccgcagcaacgacgggaagggcaacugcgggcccgugcuguccaacggcgccaacggggugaagggcuucagcuuccgguacggcaacggggucuggaucggccgcaccaaguccaucagcucccggagcggguucgagaugaucugggacccgaacggcuggaccgagacggacagcuccuucagcaucaagcaggacaucaucgcccugaccgacugguccggguacagcggcuccuucgugcagcaccccgagcucaccggcaugaacugcauccgccccugcuucuggguggagcugauccgggggcagcccaaggagagcaccaucuggacguccggcagcuccaucagcuucugcggggucgacuccgagaccgccagcugguccuggccggacggcgcggaccugcccuucaccaucgacaaguga

SEQ ID NO: 87294 - RNA, 1365 nt, Artificial Sequence; identical to SEQ ID NO: 76727
  derived and/or modified sequence opt1 from neuraminidase__InfluenzaA__EPI115409

SEQ ID NO: 87295 - RNA, 1365 nt, Artificial Sequence; identical to SEQ ID NO: 76727
  derived and/or modified sequence opt1 from neuraminidase__InfluenzaA__ABD77678/m1

SEQ ID NO: 87296 - RNA, 1410 nt, Artificial Sequence; identical to SEQ ID NO: 77736
  derived and/or modified sequence opt1 from neuraminidase__InfluenzaA__EPI185224

SEQ ID NO: 87297 - RNA, 1410 nt, Artificial Sequence; identical to SEQ ID NO: 87252
  derived and/or modified sequence opt1 from neuraminidase__InfluenzaA__EPI697745

SEQ ID NO: 87298 - RNA, 1410 nt, Artificial Sequence; identical to SEQ ID NO: 87252
  derived and/or modified sequence opt1 from neuraminidase__InfluenzaA__EPI768524

SEQ ID NO: 87299 - RNA, 1410 nt, Artificial Sequence
  derived and/or modified sequence opt1 from neuraminidase__InfluenzaA__EPI726929
augaaccccaaccagaagaucaucaccaucggcagcaucuccaugaccaucgggauggccaaccugauccuccagaucggcaacaucaucagcaucugggugucccacagcauccagaucgggaaccagucccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcgugcgcaucggcuccaagggggacguguucgucauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgaggugcccagccccuacaacucccgguucgagagcguggccugguccgcgagcgccugccacgacgggaucaacuggcugaccaucggcaucuccggccccgacagcggggccgucgccgugcucaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucaucaagagcgucgagaugaaggcccccaacuaccacuacgaggagugcuccugcuaccccgacagcuccgagaucacgugcgugugccgggacaacuggcacggcagcaaccgccccuggguguccuucaaccagaaccuggaguaccagaugggguacaucugcagcggcgucuucggggacaacccgcggcccaacgacaagaccggcuccugcggccccgugagcagcaacggggccaacggcgugaagggguucuccuucaaguacggcaacggggucuggaucggccgcaccaagagcaucuccagccggaagggcuucgagaugaucugggaccccaacggguggaccggcaccgacaacaaguucuccaucaagcaggacaucguggggaucaacgaguggagcggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgucggguggagcuggcccgacggcgccgagcucccguucacgaucgacaaguga

SEQ ID NO: 87300 - RNA, 1410 nt, Artificial Sequence; identical to SEQ ID NO: 87299
  derived and/or modified sequence opt1 from neuraminidase__InfluenzaA__EPI813816

SEQ ID NO: 87301 - RNA, 1410 nt, Artificial Sequence
  derived and/or modified sequence opt1 from neuraminidase__InfluenzaA__EPI466627
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 87302 - RNA, 1410 nt, Artificial Sequence
  derived and/or modified sequence opt1 from neuraminidase__InfluenzaA__EPI541965
augaaccccaaccagaagaucaucaccaucggcagcgugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacagcucccucugccccgugagcggcugggccaucuacuccaaggacaacagcgugcgcaucggcuccaagggggacgucuucgugauccgggagcccuucaucagcugcagcccccuggagugccgcaccuucuuccuggcccagggcgcccuccugaacgacaagcacagcaacgggaccaucaaggaccgguccccguaccgcacccugaugagcugccccaucggcgaggugcccucccccuacaacagccgguucgagagcgucgcgugguccgccagcgccugccacgacgggaucaacuggcucacgaucggcaucuccggcccggacagcggggccguggcggugcugaaguacaacggcaucaucaccgacaccaucaaguccuggcgcaacaacauccugcggacccaggagagcgagugcgccugcgucaacggguccugcuucacgaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcagcggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaacgaguggagcggcuacuccgggagcuucgugcagcaccccgagcugaccggccuggacugcauccgccccugcuucugggucgagcucauccggggccgccccgaggagaacacgaucuggaccuccgggagcuccaucagcuucugcggcgugaacuccgacaccgugggguggagcuggccggacggcgcggagcugcccuucaccaucgacaaguga

SEQ ID NO: 87303 - RNA, 1410 nt, Artificial Sequence
  derived and/or modified sequence opt1 from neuraminidase__InfluenzaA__EPI652004
augaaccccaaccagaagaucaucaccaucggcagcgugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccuggcccagggcgcccugcucaacgacaagcacuccaacgggaccaucaaggaccggagccccuaccgcacccugauguccugcccgaucggcgaggugcccagccccuacaacagccgguucgaguccgucgcguggagcgccuccgccugccacgacgggaucaacuggcugacgaucggcaucagcggccccgacuccggggccguggcggugcucaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucaccggccuggacugcauccgccccugcuucugggucgagcugauccggggccgccccgaggagaacacgaucuggaccagcggguccagcaucuccuucugcggcgugaacagcgacaccguggggugguccuggcccgacggcgcggagcucccguucaccaucgacaaguga

SEQ ID NO: 87304 - RNA, 1410 nt, Artificial Sequence
  derived and/or modified sequence opt1 from neuraminidase__InfluenzaA__EPI62526
augaacaccaaccagcgcaucaucaccaucggcacggugugccugaucgucgggaucgugagccuccugcugcagaucggcaacaucgugucccucuggaucagccacuccauccagaccggggagaagaaccaccccgagaucugcagccagaacgucaucaccuacgagaacaacaccugggugaaccagacguacgugaacaucuccaacaccaacaucgucgacggccagggggugaccagcaucauccuggccggcaacuccagccugugcccgaucuccggcugggccaucuacagcaaggacaacuccauccggaucgggagcaagggcgacaucuucgugauccgcgagcccuucaucuccugcagccaccucgagugccggaccuucuuccugacgcagggggcgcugcucaacgaccgccacuccaacggcaccgucaaggaccggagccccuaccgcacccugauguccugccccaucggggaggccccgagccccuacaacucccgguucgagagcguggccuggagcgccuccgccugccacgacggcaugggcuggcugaccaucgggaucagcggccccgacaacggggcgguggccguccucaaguacaacggcaucaucacggacaccaucaaguccuggcgcaacaagauccugcggacccaggagagcgagugcgugugcaucaacggcuccugcuucaccaucaugacggacgggcccagcaacggccaggccuccuacaagaucuucaagauggagaaggggaagaucaucaagagcguggagcuggacgccccgaacuaccacuacgaggagugcuccugcuaccccgacaccggcaaggucgugugcgugugccgcgacaacuggcacgcgagcaaccggcccugggucuccuucgaccagaaccucgacuaccagaucggguacaucugcagcggcguguucggcgacaacccccgcuccaacgacgggaagggcaacugcgggccggugcugagcaacggcgccaacggggucaagggcuucuccuuccgguacggcaacgggguguggaucggccgcaccaagagcaucuccagccgguccggguucgagaugaucugggaccccaacggcuggaccgagacggacagcagcuucuccaucaagcaggacaucaucgcccugaccgacuggagcggguacuccggcagcuucgugcagcaccccgagcucaccggcaugaacugcauccgccccugcuucugggucgagcugauccgggggcagccgaaggaguccaccaucuggacgagcggcuccagcaucuccuucugcgggguggacagcgagaccgccuccuggagcuggcccgacggcgccgaccugcccuucaccaucgacaaguga

SEQ ID NO: 87305 - RNA, 1410 nt, Artificial Sequence; identical to SEQ ID NO: 77736
  derived and/or modified sequence opt1 from neuraminidase__InfluenzaA__EPI189183

SEQ ID NO: 87306 - RNA, 1410 nt, Artificial Sequence; identical to SEQ ID NO: 77736
  derived and/or modified sequence opt1 from neuraminidase__InfluenzaA__EPI180576

SEQ ID NO: 87307 - RNA, 1410 nt, Artificial Sequence
  derived and/or modified sequence opt1 from neuraminidase__InfluenzaA__EPI346918
augaacaccaaccagcgcaucaucaccaucggcacggugugcaugaucgucgggaucaucagccugcuccugcagaucggcaacaucgugucccuguggaucagccacuccauccagaccgggugggagaaccacaccgagaugugcaaccagaacgugaucaccuacgucaacaacacgugggugaaccggaccuacgugaacgucagcaacaccaacaucgccaccauccaggacgugacguccaucgugcucgccggcaacagcucccugugccccgucagcgggugggcgaucuacuccaaggacaacagcauccgcaucggcuccaagggcgacaucuucgugauccgggagccguucaucagcugcucccagcuggagugccgcaccuucuuccucacccagggggcccugcugaacgacaagcacagcaacggcaccgugaaggaccggucccccuaccgcacgcucaugagcugccccaucggggaggcccccuccccguacaacagccgguucgaguccgucgccuggagcgccagcgcgugccacgacggcaugggguggcugaccaucggcaucuccggccccgacaacggggccguggccgugcugaaguacaacggcaucaucaccgacaccaucaagagcuggcgcaacaagauccuccggacgcaggaguccgagugcgucugcaugaacgggagcugcuucaccgugcugaccgacggccccuccaacggccaggccagcuacaagaucuucaagguggagaaggggcgcaucaucaaguccaucgagcuggacgcgcccaacuaccacuacgaggagugcagcugcuacccggacaccggcaaggucaugugcgugugccgggacaacuggcacgccuccaaccgccccugggugagcuucaaccagaaccucgacuaccagaucggguacaucugcuccggcgucuucggggacaacccccggagcaacgacggcaagggcaacugcgggcccgugcuguccaacggcgccaacggggugaagggcuucagcuaccgcuacgggaacggcgucuggaucggccggacgaaguccaucaacagccgccggggguucgagaucaucugggacccgaacggcuggaccgagaccgacuccagcuucuccaugaagcaggacaucaucgcccugaccgacuggagcggguacagcggcuccuucgugcagcaccccgagcucacggggaugaacugcauccgccccugcuucugggucgagcugauccggggccagcccaaggagagcaccaucugggccuccggcagcuccaucagcuucugcggggugaacuccgagaccgcgagcugguccuggccggacggcgccgaccugcccuucaccaucgacaaguga

SEQ ID NO: 87308 - RNA, 1410 nt, Artificial Sequence; identical to SEQ ID NO: 78324
  derived and/or modified sequence opt1 from neuraminidase__InfluenzaA__EPI240976

SEQ ID NO: 87309 - RNA, 1410 nt, Artificial Sequence; identical to SEQ ID NO: 75103
  derived and/or modified sequence opt1 from neuraminidase__InfluenzaA__EPI3165

SEQ ID NO: 87310 - RNA, 1410 nt, Artificial Sequence; identical to SEQ ID NO: 87029
  derived and/or modified sequence opt1 from neuraminidase__InfluenzaA__EPI957

SEQ ID NO: 87311 - RNA, 1410 nt, Artificial Sequence; identical to SEQ ID NO: 83154
  derived and/or modified sequence opt1 from neuraminidase__InfluenzaA__EPI507593

SEQ ID NO: 87312 - RNA, 1410 nt, Artificial Sequence; identical to SEQ ID NO: 83154
  derived and/or modified sequence opt1 from neuraminidase__InfluenzaA__EPI461954

SEQ ID NO: 87313 - RNA, 1410 nt, Artificial Sequence; identical to SEQ ID NO: 83154
  derived and/or modified sequence opt1 from neuraminidase__InfluenzaA__EPI461954

SEQ ID NO: 87314 - RNA, 1410 nt, Artificial Sequence
  derived and/or modified sequence opt1 from neuraminidase__InfluenzaA__EPI668104
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuucuaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcaacgccuccggcaaggccgacaccaagauccuguucaucgaggaggggaagaucgugcacacgagcaagcucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucguggagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcggccggaaggaggagaccgagguccucuggaccagcaacagcaucgugguguucugcgggaccuccggcacguacgggaccggcagcuggcccgacggggccgaccugaaccugaugcccaucuga

SEQ ID NO: 87315 - RNA, 1410 nt, Artificial Sequence
  derived and/or modified sequence opt1 from neuraminidase__InfluenzaA__EPI578445
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcaacgccuccggcaaggccgacaccaagauccuguucaucgaggaggggaagaucgugcacacgagcaagcucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucguggagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcggccggaaggaggagaccgagguccucuggaccagcaacagcaucgugguguucugcgggaccuccggcacguacgggaccggcagcuggcccgacggggccgaccugaaccugaugcccaucuga

SEQ ID NO: 87316 - RNA, 1410 nt, Artificial Sequence; identical to SEQ ID NO: 87315
  derived and/or modified sequence opt1 from neuraminidase__InfluenzaA__EPI551883

SEQ ID NO: 87317 - RNA, 1410 nt, Artificial Sequence
  derived and/or modified sequence opt1 from neuraminidase__InfluenzaA__EPI344388
augaaccccaaccagaagaucaucaccaucggcagcgugucccugaucaucgccaccaucugcuuccucaugcagaucgccauccuggucacgaccgugacccugcacuucaagcagcacgacuacaacagcccgcccaacaaccaggcgaugcucugcgagcccaccaucaucgagcgcaacacgaccgagaucguguaccugaccaacaccacgaucgagaaggagaucugccccaagcuggccgaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacaacaccgugcacgaccgcaccccguaccggacccuccugaugaacgagcugggcguccccuuccaccucgggacgcgccaggugugcauggcgugguccagcuccagcugccacgacggcaaggccuggcugcacgugugcaucaccgggaacgacaacaacgccaccgccuccuucaucuacaacggccggcuggucgacagcaucggguccuggagcaagaacauccuccgcacccaggaguccgagugcgugugcaucaacggcacgugcaccguggucaugaccgacggcagcgcguccgggaaggccgacaccaagauccuguucguggaggagggcaagaucgugcacaucagcacgcugagcggguccgcccagcacgucgaggagugcagcugcuacccccgguuccccggcgugcgcugcgugugccgggacaacuggaagggcuccaaccgcccgaucgucgacaucaacgugaagaacuacagcaucguguccagcuacgucugcuccgggcucgugggcgacacgccccgcaagagcgacuccgugagcuccagcuacugccuggaccccaacaacgagaagggcgggcacggggucaagggcugggccuucgacgacggcaacgacguguggauggggcggaccaucaacgagacccugcggcucggcuacgagaccuucaaggucaucgaggggugguccaaggccaacagcaagcugcagaccaaccgccaggugaucguggagaagggcgaccgguccggguacagcggcaucuucuccgucgagggcaagagcugcaucaaccgcugcuucuacguggagcugauccgggggcgcaaggaggagaccaaggugugguggaccuccaacagcaucgucguguucugcggcacgagcgggaccuacggcaccggguccuggcccgacggcgcggacaucaaccucaugccgaucuga

SEQ ID NO: 87318 - RNA, 1410 nt, Artificial Sequence; identical to SEQ ID NO: 87317
  derived and/or modified sequence opt1 from neuraminidase__InfluenzaA__EPI347601

SEQ ID NO: 87319 - RNA, 1410 nt, Artificial Sequence
  derived and/or modified sequence opt1 from neuraminidase__InfluenzaA__EPI642512
augaaccccaaccagaagaucaucaccaucggcagcaucucccugaucaucgccaccaucugcuuccucaugcagaucgccauccuggugaucacggucacccugcacuucaagcagcacaacugcgacagcuccccgaacaaccaggugauguucugcgagcccaccaucaucgagcgcaacaagaccgagaucguguaccucaucaacacgaccgucgagaaggagaucugccccaagcccaccgaguaccggaacuggagcaagccgcagugcaacaucaccggguucgcgcccuucuccaaggacaacagcauccgccuguccgccggcggggacaucugggugacgcgggagcccuacgugagcugcgaccccgacaagugcuaccaguucgcccugggccaggggaccacccucaacaacggccacuccaacgacaccguccacgaccgcacgccguaccggacccugcugaugaacgagcucggcgugcccuuccaccuggggacccgccaggugugcaucgccuggagcuccagcuccugccacgacggcaaggccuggcugcacgucugcaucaccggggacgacggcaacgcgacggccagcuucaucuacaacgggcggcucguggacuccaucggcagcugguccaagaacauccugcgcacccaggagagcgagugcgugugcaucaacgggaccugcaccgucgugaugacggacggcuccgccagcggcaaggccgacaccaagauccuguucaucgaggaggggaagaucauccacaucagcacccucuccggcagcgcgcagcacguggaggagugcuccugcuacccccgguaccccggcguccgcugcgugugccgggacaacuggaaggggagcaaccgcccgaucguggacaucaacgucaaggacuacuccaucgugagcuccuacgugugcagcggccuggucggggacacgccccggaagaacgacuccuucagcuccagccacugccuggaccccaacaacgaggagggcgggcacggcgugaagggcugggccuucgacgacgggaacgacguguggaugggccgcaccaucuccgagaagucccggcucggguacgagaccuucaaggucgugaagggcuggagcgagcccaacagcaagcugcagaccaaccgccaggucaucguggggcggggcaaccgcuccggcuacagcgggaucuucuccaucgagggcaagaacugcaucaaccggugcuucuacguggagcugauccgcgggcggaaggaggagaccaaggucugguggacgagcaacagcaucgugguguucugcggcaccuccgggaccuacggcaccggcagcuggccggacggggccgacaucaaccucaugcccaucuga

SEQ ID NO: 87320 - RNA, 1410 nt, Artificial Sequence
  derived and/or modified sequence opt1 from neuraminidase__InfluenzaA__AIE52540
augaaccccaaccagaagaucaucaccaucggcagcgugucccugaucaucgccaccaucugcuuccucaugcagaucgccauccuggucacgaccgugacccugcacuucaagcagcacgacuacaacagcccgcccaacaaccaggugaugcucugcgagcccaccaucaucgagcgcaacacgaccgagaucgucuaccugaccaacaucaccaucgagaaggagaucugccccaagcuggcggaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacaacacgguccacgaccgguccccguaccgcacccuccugaugaacgagcugggcgugcccuuccaccucggcacccgccaggugugcaucgccuggagcuccagcuccugccacgacgggaaggcguggcugcacgucugcaucaccggcgacgacaacaacgccacggccagcuucaucuacaacgggcggcugguggacuccaucggcagcugguccaagaacauccuccggacccaggagagcgagugcgugugcaucaacgggaccugcaccgucgugaugacggacggcuccgccagcggcaaggcggacaccaagauccuguucaucgaggaggggaagaucgugcacaucagcacccuguccggcagcgcccagcacgucgaggagugcuccugcuacccccgcuaccccggggugcggugcgugugccgcgacaacuggaagggcagcaaccggccgaucgucgacaucaacaugaaggacuacuccaucgccagcuccuacgugugcagcggccucgugggggacacgccccgcaagaacgacuccuucagcuccagccacugccuggaccccaacaacgagaagggcgggcacggcgucaaggggugggccuucgacgacggcaacgacguguggaugggccggaccaucuccgaggaguuccgccugggguacgagaccuucaaggugaucaagggcuggagcaaccccaacuccaagcuccagaccaaccggcaggucaucguggagaaggggaaccgcagcggcuacuccggggucuucagcaucgaggacaaguccugcaucaaccggugcuucuacguggagcugauccgcggccggaaggaggagaccaaggugugguggacgagcaacagcaucgucguguucugcggcaccuccgggaccuacggcaccgggagcuggccggacggcgccgacaucaaccugaugcccaucuga

SEQ ID NO: 87321 - RNA, 1410 nt, Artificial Sequence; identical to SEQ ID NO: 87320
  derived and/or modified sequence opt1 from neuraminidase__InfluenzaA__EPI465399

SEQ ID NO: 87322 - RNA, 1410 nt, Artificial Sequence; identical to SEQ ID NO: 87320
  derived and/or modified sequence opt1 from neuraminidase__InfluenzaA__EPI328899

SEQ ID NO: 87323 - RNA, 1410 nt, Artificial Sequence; identical to SEQ ID NO: 87320
  derived and/or modified sequence opt1 from neuraminidase__InfluenzaA__EPI328901

SEQ ID NO: 87324 - RNA, 1410 nt, Artificial Sequence
  derived and/or modified sequence opt1 from neuraminidase__InfluenzaA__EPI574645
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacggccacuccaacaacaccguccgcgaccggacccccuaccgcacccugcugaugaacgagcucggggugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggacauccugcgcacccaggagagcgagugcgugugcaucaacggcacgugcaccguggucaugaccgacggcuccgccagcgggaaggccgacaccaagauccuguucaucgaggagggcaagaucauccacacgagcacccucuccgggagcgcgcagcacguggaggagugcuccugcuacccccgguacccgggcgugcgcugcgucugccgggacaacuggaagggcagcaaccgccccaucguggacaucaacaucaaggaccacuccaucgugagcuccuacgucugcagcgggcuggugggcgacaccccgcggaagaacgacuccagcuccagcucccacugccuggaccccaacaacgaggagggcgggcacggggugaagggcugggccuucgacgacggcaacgacgucuggauggggcgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaacgaggugcucuggaccagcaacuccaucguggucuucugcggcaccagcgggacguacggcaccggguccuggcccgacggcgccgaccugaaccugaugcccaucuga

SEQ ID NO: 87325 - RNA, 1410 nt, Artificial Sequence
  derived and/or modified sequence opt1 from neuraminidase__InfluenzaA__EPI563214
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcuccaucaccggguucgcgcccuucagcaaggacaacuccauccgccugagcgccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggacauccugcgcacccaggaguccgagugcgugugcaucaacggcacgugcaccguggucaugaccgacgggagcgccagcggcaaggccgacaccaagauccuguucaucgaggagggcaagaucguguacacguccaagcucagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcagcggguacuccggcaucuucagcguggagggcaagagcugcaucaaccggugcuucuacguggagcugauccgcgggcggaaggaggagaccgagguccucuggaccuccaacagcaucgugguguucugcggcaccuccgggacguacggcaccgggagcuggcccgacggcgccgaccugaaccugaugcccaucuga

SEQ ID NO: 87326 - RNA, 1410 nt, Artificial Sequence; identical to SEQ ID NO: 87325
  derived and/or modified sequence opt1 from neuraminidase__InfluenzaA__EPI553998

SEQ ID NO: 87327 - RNA, 1410 nt, Artificial Sequence
  derived and/or modified sequence opt1 from neuraminidase__InfluenzaA__EPI551568
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcuccaucaccggguucgcgcccuucagcaaggacaacuccauccgccugagcgccggcggggacaucugggucacccgggagcccuacguguccugcgacccggacaagugcuaccaguucgcccugggccaggggaccacgcucaacaacgugcacagcaacaacaucguccgcgaccggacccccuaccgcacccugcugaugaacgagcucggcgugcccuuccaccugggcaccaagcaggucugcaucgccugguccagcuccagcugccacgacgggaaggccuggcugcacgugugcaucacgggcgacgacaagaacgcgaccgccuccuucaucuacaacgggcggcucguggacagcguggucuccuggagcaaggacauccugcgcacccaggaguccgagugcgugugcaucaacgggaccugcacgguggucaugaccgacgggagcgccagcggcaaggccgacaccaagauccuguucaucgaggagggcaagaucguguacaccuccaagcucagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcggccacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcagcggguacuccggcaucuucagcguggagggcaagagcugcaucaaccggugcuucuacguggagcugauccgcgggcggaaggaggagacggagguccucuggaccuccaacagcaucgugguguucugcggcaccuccgggaccuacggcacggggagcuggcccgacggcgccgaccugaaccugaugcccaucuga

SEQ ID NO: 87328 - RNA, 1410 nt, Artificial Sequence
  derived and/or modified sequence opt1 from neuraminidase__InfluenzaA__EPI629737
augaaccccaaccagaagaucaucgccaucggcagcgugucccugaccaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggagcaagccccagugcuccaucacgggguucgcccccuucagcaaggacaacuccauccgccugagcgccggcggggacaucugggucacccgggagcccuacguguccugcgacccggacaagugcuaccaguucgcccugggccaggggaccacccucaacaacgugcacagcaacaacacgguccgcgaccggacccccuaccgcacccugcugaugaacgagcucggcgugcccuuccaccugggcaccaagcaggucugcaucgccugguccagcuccagcugccacgacgggaaggcguggcugcacgugugcaucacgggcgacgacaagaacgccaccgccuccuucaucuacaacgggcggcucguggacagcguggucuccuggagcaaggacauccugcgcacccaggaguccgagugcgugugcaucaacgggaccugcacgguggucaugaccgacgggagcgccagcggcaaggcggacaccaagauccuguucaucgaggagggcaagaucguguacaccuccaagcucagcggguccgcccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcggccacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcagcggguacuccggcaucuucagcguggagggcaagagcugcaucaaccggugcuucuacguggagcugauccgcgggcggaaggaggagacggagguccucuggaccuccaacagcaucgugguguucugcggcaccuccgggaccuacggcacggggagcuggcccgacggcgccgaccugaaccugaugcccaucuga

SEQ ID NO: 87329 - RNA, 1410 nt, Artificial Sequence; identical to SEQ ID NO: 87325
  derived and/or modified sequence opt1 from neuraminidase__InfluenzaA__EPI631886

SEQ ID NO: 87330 - RNA, 1410 nt, Artificial Sequence; identical to SEQ ID NO: 87325
  derived and/or modified sequence opt1 from neuraminidase__InfluenzaA__EPI577025

SEQ ID NO: 87331 - RNA, 1410 nt, Artificial Sequence; identical to SEQ ID NO: 84879
  derived and/or modified sequence opt1 from neuraminidase__InfluenzaA__EPI404926

SEQ ID NO: 87332 - RNA, 1410 nt, Artificial Sequence; identical to SEQ ID NO: 84879
  derived and/or modified sequence opt1 from neuraminidase__InfluenzaA__EPI492687

SEQ ID NO: 87333 - RNA, 1410 nt, Artificial Sequence
  derived and/or modified sequence opt1 from neuraminidase__InfluenzaA__EPI530648
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaccaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 87334 - RNA, 1410 nt, Artificial Sequence; identical to SEQ ID NO: 87315
  derived and/or modified sequence opt1 from neuraminidase__InfluenzaA__EPI684314

SEQ ID NO: 87335 - RNA, 1410 nt, Artificial Sequence
  derived and/or modified sequence opt1 from neuraminidase__InfluenzaA__EPI614459
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaccaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 87336 - RNA, 1410 nt, Artificial Sequence; identical to SEQ ID NO: 87335
  derived and/or modified sequence opt1 from neuraminidase__InfluenzaA__EPI541466

SEQ ID NO: 87337 - RNA, 1410 nt, Artificial Sequence; identical to SEQ ID NO: 87335
  derived and/or modified sequence opt1 from neuraminidase__InfluenzaA__EPI696968

SEQ ID NO: 87338 - RNA, 1410 nt, Artificial Sequence; identical to SEQ ID NO: 87335
  derived and/or modified sequence opt1 from neuraminidase__InfluenzaA__EPI674598

SEQ ID NO: 87339 - RNA, 1410 nt, Artificial Sequence; identical to SEQ ID NO: 87333
  derived and/or modified sequence opt1 from neuraminidase__InfluenzaA__EPI530678

SEQ ID NO: 87340 - RNA, 1410 nt, Artificial Sequence
  derived and/or modified sequence opt1 from neuraminidase__InfluenzaA__EPI530680
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggacauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacggcguguggauggggcgcaccaucaacgagacgagccggcucggcuacgagaccuucaaggucaucgaggggugguccaaccccaagagcaagcugcagaccaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggcccgacggcgccgaccugaaccugaugcccaucuga

SEQ ID NO: 87341 - RNA, 1410 nt, Artificial Sequence; identical to SEQ ID NO: 75046
  derived and/or modified sequence opt1 from neuraminidase__InfluenzaA__EPI7603

SEQ ID NO: 87342 - RNA, 1410 nt, Artificial Sequence; identical to SEQ ID NO: 87333
  derived and/or modified sequence opt1 from neuraminidase__InfluenzaA__EPI814527

SEQ ID NO: 87343 - RNA, 1410 nt, Artificial Sequence; identical to SEQ ID NO: 87333
  derived and/or modified sequence opt1 from neuraminidase__InfluenzaA__EPI674737

SEQ ID NO: 87344 - RNA, 1410 nt, Artificial Sequence; identical to SEQ ID NO: 87333
  derived and/or modified sequence opt1 from neuraminidase__InfluenzaA__EPI614443

SEQ ID NO: 87345 - RNA, 1410 nt, Artificial Sequence; identical to SEQ ID NO: 87333
  derived and/or modified sequence opt1 from neuraminidase__InfluenzaA__EPI551812

SEQ ID NO: 87346 - RNA, 1410 nt, Artificial Sequence; identical to SEQ ID NO: 87333
  derived and/or modified sequence opt1 from neuraminidase__InfluenzaA__EPI696961

SEQ ID NO: 87347 - RNA, 1410 nt, Artificial Sequence; identical to SEQ ID NO: 87333
  derived and/or modified sequence opt1 from neuraminidase__InfluenzaA__EPI740789

SEQ ID NO: 87348 - RNA, 1410 nt, Artificial Sequence
  derived and/or modified sequence opt1 from neuraminidase__InfluenzaA__EPI377498
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccacgaccgcacccccuaccggacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccggcaggucaucguggaccgcggggaccgguccggcuacagcgggaucuucuccguggagggcaagagcugcaucaaccgcugcuucuacguggagcugauccggggccgcaaggaggagaccgaggugcucuggaccagcaacuccaucgucguguucugcgggacgagcggcaccuacgggaccggcuccuggcccgacggggccgaccugaaccugaugcccaucuga

SEQ ID NO: 87349 - RNA, 1410 nt, Artificial Sequence; identical to SEQ ID NO: 87348
  derived and/or modified sequence opt1 from neuraminidase__InfluenzaA__EPI377498

SEQ ID NO: 87350 - RNA, 1410 nt, Artificial Sequence; identical to SEQ ID NO: 87348
  derived and/or modified sequence opt1 from neuraminidase__InfluenzaA__EPI391246

SEQ ID NO: 87351 - RNA, 1410 nt, Artificial Sequence; identical to SEQ ID NO: 87348
  derived and/or modified sequence opt1 from neuraminidase__InfluenzaA__EPI407122

SEQ ID NO: 87352 - RNA, 1410 nt, Artificial Sequence; identical to SEQ ID NO: 87348
  derived and/or modified sequence opt1 from neuraminidase__InfluenzaA__EPI407125

SEQ ID NO: 87353 - RNA, 1410 nt, Artificial Sequence; identical to SEQ ID NO: 87315
  derived and/or modified sequence opt1 from neuraminidase__InfluenzaA__EPI562038

SEQ ID NO: 87354 - RNA, 1410 nt, Artificial Sequence; identical to SEQ ID NO: 87315
  derived and/or modified sequence opt1 from neuraminidase__InfluenzaA__EPI562038

SEQ ID NO: 87355 - RNA, 1410 nt, Artificial Sequence; identical to SEQ ID NO: 83625
  derived and/or modified sequence opt1 from neuraminidase__InfluenzaA__EU716525

SEQ ID NO: 87356 - RNA, 1350 nt, Artificial Sequence
  derived and/or modified sequence opt1 from neuraminidase__InfluenzaA__EPI232422
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagccccaacggcgcguacggggucaagggcuucuccuucaaguacgggaacggcguguggaucggccggaccaagagcaccaacucccgcagcggguucgagaugaucugggacccgaacggcuggaccgggaccgacagcuccuucagcgugaagcaggacaucgucgccaucacggacugguccggcuacagcggguccuucgugcagcaccccgagcugaccggccucgacugcauccggcccugcuucugggucgagcugauccgcggccggcccaaggagagcaccaucuggaccuccgggagcuccaucagcuucugcggcgugaacuccgacacggugagcugguccuggccggacggggccgagcugcccuucaccaucgacaaguga

SEQ ID NO: 87357 - RNA, 1350 nt, Artificial Sequence; identical to SEQ ID NO: 87192
  derived and/or modified sequence opt1 from neuraminidase__InfluenzaA__EPI227593

SEQ ID NO: 87358 - RNA, 1350 nt, Artificial Sequence
  derived and/or modified sequence opt1 from neuraminidase__InfluenzaA__EPI435658
augaaccccaaccagaagaucgugaccaucggcagcaucugcauggucaucgggaucaucucccugaugcuccagaucggcaacaucaucagcaucugggugucccacagcauccagaccgggaaccagcaccagacggagccgauccgcaacaccaacuuccugaccgagaacgccguggccuccgucacccuggcgggcaacagcucccucugccccauccgggggugggccgugcacagcaaggacaacuccauccgcaucggcagcaagggcgacguguucgucauccgggagcccuucaucuccugcagccaccuggagugccgcacguucuuccugacccagggggcccuccugaacgacaagcacuccaacggcaccgugaaggaccggagcccccaccgcacccugauguccugcccgaucggggaggcccccagccccuacaacucccgguucgagagcguggccugguccgcgagcgccugccacgacggcacgagcuggcucaucaucgggaucuccggccccgacaacggcgccgucgccgugcugaaguacaacgggaucaucaccgacaccaucaagagcuggcgcaacaacauccugcggacccaggaguccgagugcgcgugcgugaacggcagcugcuucacggucaugaccgacgggccguccaacggccaggccagcuacaagaucuucaagaucgagaagggcaagguggugaaguccgucgagcucaacgcccccaacuaccacuacgaggagugcagcugcuaccccgacgccggggagaucaucugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgggcccgugucccccaacggcgccuacggggugaagggcuucagcuucaaguacgggaacggcgucuggaucggccggaccaaguccacgcacagccgcuccggguucgagaugaucugggacccgaacggcuggaccgggaccgacagcgaguucuccaugaagcaggacaucguggcgaucaccgacuggagcggcuacagcggguccuucgugcagcaccccgagcugacgggccucgacugcauccggcccugcuucugggucgagcugauccgcggccggcccaaggagagcaccaucuggaccuccgggagcuccaucagcuucugcggcgugaacuccgacaccgucagcugguccuggccggacggggccgagcugcccuucacgaucgacaaguga

SEQ ID NO: 87359 - RNA, 1350 nt, Artificial Sequence; identical to SEQ ID NO: 87358
  derived and/or modified sequence opt1 from neuraminidase__InfluenzaA__EPI492513

SEQ ID NO: 87360 - RNA, 1350 nt, Artificial Sequence; identical to SEQ ID NO: 80705
  derived and/or modified sequence opt1 from neuraminidase__InfluenzaA__EPI165066

SEQ ID NO: 87361 - RNA, 1350 nt, Artificial Sequence
  derived and/or modified sequence opt1 from neuraminidase__InfluenzaA__EPI531308
augaaccccaaccagaagaucaucaccaucggcagcaucugcauggugaccggggucgugucccugaugcuccaggugggcaacaugaucagcaucuggaucucccacagcauccacacggggaaccagcaccaggccgagccgaucuccaacaccaacuuccacaccgagaaggccgucgugagcgcgaagcuggccggcaacuccagccugugccccaucaacgggugggccguguacuccaaggacaacagcauccgcaucggcuccaagggcgacgucuucgugauccgggagcccuucaucagcugcucccaccucgagugccgcaccuucuuccugacgcagggggcccugcucaacgacaagcacagcaacggcaccgccaaggaccggagcccccaccgcacccugauguccugcccggugggggaggcgcccucccccuacaacagccgguucgaguccgucgccuggagcgccagcgccugccacgacggcaccuccuggcugacgaucgggaucagcggccccgacaacggcgcgguggccgugcucaaguacaacgggaucaucaccgacaccaucaaguccuggcgcaacaacguccugcggacccaggagagcgagugcgccugcgugaacggcuacugcuucacggugaugaccgacgggccguccaacggccaggccagccacaagaucuucaagauggagaagggcaaggucaucaaguccguggagcuggacgcccccaacuaccacuacgaggagugcagcugcuaccccgacgcgggggagaucacgugcgugugccgcgacaacuggcacggcuccaaccggcccuggaucagcuucaaccagaaccucgaguaccagaucggguacaucugcuccggcgucuucggggacaacccgcgccccaacgacggcaagggcagcugcgggcccguguccagcaacggcgccuacggggugaagggcuucuccuucaaguacgggaacggcgucuggaucggccggaccaagagcaccaacucccgcagcggguucgagaugaucugggaccccaacggcuggaccgagaccgacuccagcuucagcgugaagcaggacaucguggccaucaccgacugguccggguacagcggcuccuucguccagcacccggagcugacggggcuggacugcauccggcccugcuucuggguggagcucauccgcggccggcccaaggagggcaccaucuggaccagcggguccagcaucuccuucugcggcgucagcggggacaccgugggcugguccuggcccgacggcgccgagcugccguucacgaucgacaaguga

SEQ ID NO: 87362 - RNA, 1350 nt, Artificial Sequence
  derived and/or modified sequence opt1 from neuraminidase__InfluenzaA__EPI433308
augaaccccaaccagaagaucaucaccaucggcagcaucugcauggugaucgggaucgucucccugaugcuccagaucggcaaccugaucagcaucugggugucccacagcauccagcgcgggaaccugaaccagguggagccgaucuccaacaccagcuuccccacggagaaggccgucgccuccgugacccucgcgggcaacagcucccugugccccauccgggggugggccgugcacagcaaggacaacuccauccgcaucggcagcaagggcgacgucuucgugauccgggagcccuucaucuccugcagccaccuggagugccgcaccuucuuccucacccagggggcccugcugaacgacaagcacuccaacggcacggugaaggaccggagcccgcaccgcacccucauguccugccccgucggggaggcccccagccccuacaacucccgguucgagagcguggccuggagcgcguccgccugccacgacggcaccagcuggcugaccaucgggaucuccggcccggacaacggcgccguggccgucgugaaguacaacgggaucaucacggacaccaucaagagcuggggcaacaacauccugcgcacccaggaguccgagugcgcgugcgugaacgggagcugcuucaccgucaugacggacggccccuccaacggccaggccagcuacaagaucuucaagauggagaaggggaaggugaucaaguccguggagcucgacgcccccaacuaccacuacgaggagugcagcugcuaccccgacgccggcgagaucacgugcgucugccgggacaacuggcacggguccaaccgcccgugggugagcuucaaccagaaccuggaguaccagaucggcuacaucugcuccgggguguucggcgacaacccccggcccaacgacggcaccgggagcugcggccccgucuccccgaacggggccuacggcgugaagggguucagcuucaaguacggcaacggcguguggaucgggcgcaccaagucccccaacagccgguccggcuucgagaugaucugggaccccaacggguggagcgagaccgacagcuccuucagcgucaagcaggacauccuggcggugaccgacugguccggcuacagcggguccuucguccagcaccccgagcucaccggccuggacugcauccgcccgugcuucuggguggagcugauccggggccgccccgaggagagcaccaucuggacguccgggagcuccaucagcuucugcggcgugaacuccgacaccgucagcugguccuggcccgacggggccgagcuccccuucaccaucgacaaguga

SEQ ID NO: 87363 - RNA, 1350 nt, Artificial Sequence
  derived and/or modified sequence opt1 from neuraminidase__InfluenzaA__EPI114974
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagcuacaagaucuucaagauggagaagggcaagguggucaaguccaucgagcucgacgcccccaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgggcccgugucccccaacggcgcguacggggugaagggcuucagcuucaaguacgggaacggcgucuggaucggccggaccaaguccaccaacagccgcuccggguucgagaugaucugggacccgaacggcuggaccgggaccgacagcagcuucuccgugaagcaggacaucguggccaucacggacuggagcggcuacuccgggagcuucguccagcaccccgagcugaccggccucgacugcauccggcccugcuucuggguggagcugauccgcggccggcccaaggaguccaccaucuggaccagcggguccagcaucuccuucugcggcgucaacagcgacacgguguccuggagcuggccggacggggccgagcugcccuucaccaucgacaaguga

SEQ ID NO: 87364 - RNA, 1350 nt, Artificial Sequence
  derived and/or modified sequence opt1 from neuraminidase__InfluenzaA__EPI622495
augaaccccaaccagaagaucaccaccaucggcagcaucugcauggugaucgggaucgucucccugaugcuccagaucggcaacauggugagcaucugggugucccacagcauccagacgcgcaaccagcggcaggccgagccgaucuccaacacccgcagccugaccgagaaggccgucgcguccgugacccuggccgggaacagcucccucugccccaucagcggcugggccguguacuccaaggacaacagcauccggaucggguccaagggcgacgucuucgugauccgcgagcccuucaucagcugcucccaccuggagugccggacguucuuccugacccagggcgcccuccugaacgacaagcacagcaacgggaccgugaaggaccgcagcccccaccggacccugauguccugcccggucggcgaggcccccucccccuacaacagccgcuucgagagcguggcgugguccgccagcgccugccacgacgggacguccuggcucaccaucggcaucagcgggcccgacaacggcgccguggcggucgugaaguacaacggcaucaucaccgacaccaucaaguccuggcggaacaacauccugcgcacgcaggagagcgagugcgugugcgucaacggguccugcuucaccgugaugaccgacggcccgagcaacaagcaggccuccuacaagaucuucaagauggagaaggggaagguggucaagagcaucgagcuggacgcccccaacuaccacuacgaggagugcuccugcuaccccgacgccggcgagaucacgugcgugugccgggacaacuggcacggcagcaaccgccccuggcucuccuucaaccagaaccuggaguaccagaucggguacaucugcagcggcguguucggggacaacccgcggcccaacgacggcaccggguccugcggccccgucagcuccaacggcgccuacggggugaagggcuucagcuucaaguacgggaacggcguguggaucgggcgcaccaaguccaccaacagccggagcggcuucgagaugaucugggaccccaacggcuggaccgggacggacuccagcuucuccaugaagcaggacaucgucgcgaucaccgacuggagcggcuacuccgggagcuucgugcagcacccggagcugaccggccucgacugcauccgccccugcuucugggucgagcuggugcgggggcgccccaaggagggcaccaucuggacguccggcagcuccaucagcuucugcggggugaacuccgacaccgucagcugguccuggcccgacggcgccgagcugccguucaccaucgacaaguga

SEQ ID NO: 87365 - RNA, 1350 nt, Artificial Sequence
  derived and/or modified sequence opt1 from neuraminidase__InfluenzaA__EPI349847
augaaccccaaccagaagaucaccaccaucggcagcaucugcauggugaucgggaucgucucccugaugcuccagaucggcaacauggugagcaucugggugucccacagcauccagacgcgcaaccagcggcaggccgagccgaucuccaacacccgcagccugaccgagaaggccgucgcguccgugacccuggccgggaacagcucccucugccccaucagcggcugggccguguacuccaaggacaacagcauccggaucggguccaagggcgacgucuucgugauccgcgagcccuucaucagcugcucccaccuggagugccggacguucuuccugacccagggcgcccuccugaacgacaagcacagcaacgggaccgugaaggaccgcagcccccaccggacccugauguccugcccggucggcgaggcccccucccccuacaacagccgcuucgagagcguggcgugguccgccagcgccugccacgacgggacguccuggcucaccaucggcaucagcgggcccgacaacggcgccguggcggucgugaaguacaacggcaucaucaccgacaccaucaaguccuggcggaacaacauccugcgcacgcaggagagcgagugcgugugcgucaacggguccugcuucaccgugaugaccgacggcccgagcaacaagcaggccuccuacaagaucuucaagauggagaaggggaagguggucaagagcaucgagcuggacgcccccaacuaccacuacgaggagugcuccugcuaccccgacgccggcgagaucacgugcgugugccgggacaacuggcacggcagcaaccgccccuggcucuccuucaaccagaaccuggaguaccagaucggguacaucugcagcggcguguucggggacaacccgcggcccaacgacggcaccggguccugcggccccgucagccacaacggcgccuacggggugaagggcuucuccuucaaguacgggaacggcguguggaucgggcgcaccaagagcaccaacucccggagcggcuucgagaugaucugggaccccaacggcuggaccgggacggacagcuccuucagcaugaagcaggacaucgucgcgaucaccgacugguccggcuacagcggguccuucgugcagcacccggagcugaccggccucgacugcauccgccccugcuucugggucgagcuggugcgggggcgccccaaggagggcaccaucuggacgagcggcuccagcaucuccuucugcggggugaacagcgacaccgucuccuggagcuggcccgacggcgccgagcugccguucaccaucgacaaguga

SEQ ID NO: 87366 - RNA, 1350 nt, Artificial Sequence
  derived and/or modified sequence opt1 from neuraminidase__InfluenzaA__EPI174804
augaaccccaaccagaagaucaucaccaucggcagcaucugcauggugaucgggaucgucucccugaugcuccagaucggcaacauggugagcaucugggugucccacagcauccagacccgcaaccagcggcaggccgagccgaucuccaacaccaagagccugaccgagaaggccgucgcguccgugacccuggccgggaacagcucccucugccccaucagcggcugggccguguacuccaaggacaacagcauccgcaucggguccaagggcgacgucuucgugauccgggagcccuucaucagcugcucccaccuggagugccgcaccuucuuccugacgcagggcgcccuccugaacgacaagcacagcaacgggaccaucaaggaccggagcccccaccgcacccugauguccugcccggugggcgaggcccccucccccuacaacagccgguucgagagcgucgcgugguccgccagcgccugccacgacgggaccuccuggcucacgaucggcaucagcgggcccgacaacggcgccguggcggugcugaaguacaacggcaucaucaccgacaccaucaaguccuggcgcaacaacauccugcggacccaggagagcgagugcgccugcgucaacggguccugcuucgccgugaugacggacggcccgagcaaccgccaggccuccuacaagaucuucaagauggagaaggggaagguggucaagagcaucgagcucgacgcccccaacuaccacuacgaggagugcuccugcuaccccgacgcgggcgagaucacgugcgugugccgggacaacuggcacggcagcaaccgccccuggcuguccuucaaccagaaccuggaguaccagaucggguacaucugcagcggcguguucggggacaacccgcggcccaacgacggcaccggguccugcggccccgucagcuccaacggcgccuacggggugaagggcuucagcuucaaguacgggaacggcguguggaucgggcgcaccaaguccacgaacagccggagcggcuucgagaugaucugggaccccaacggcuggaccgagaccgacuccagcuucuccaugaagcaggacaucgucgccaucaccgacuggagcggguacuccggcagcuucgugcagcacccggagcucacggggcuggacugcauccgccccugcuucuggguggagcugguccggggccgccccaaggaguccaccaucuggaccagcggguccagcaucuccuucugcggcgugaacagcgacaccgucuccuggagcuggcccgacggcgccgagcucccguucacgaucgacaaguga

SEQ ID NO: 87367 - RNA, 1350 nt, Artificial Sequence
  derived and/or modified sequence opt1 from neuraminidase__InfluenzaA__EPI492441
augaaccccaaccagaagaucauggccaucggcagcgugugcauggucaucgggaucgugucccugaugcuccagaucggcaacaccaucagcaucugggugucccacagcuuccagacccgcguccagcaccaggccgagccgauccggaacacgaacuuccugaccgagaacgcgguggccuccgugacccuggccgggaacagcucccucugccccauccgcggcugggccguccacagcaaggacaacuccauccggaucgggagcaagggcgacguguucgugauccgcgagcccuucaucuccugcagccaccuggagugccggaccuucuuccugacgcagggcgcccuccugaacgacaagcacuccaaccgcaccgucaaggaccggagcccccaccgcacccugauguccugcccggugggggaggugcccagccccuacaacucccgguucgagagcgucgcgugguccgccagcgccugccacgacggcaccagcuggcucacgaucgggaucuccggccccgacaacggggccguggcggugcugaaguacaacggcaucaucaccgacaccaucaagagcuggcgcaacaacauccugcggacccaggaguccgagugcgccugcgucaacggcuucugcuucacggugaugaccgacgggccgagcaacggccaggccuccuacaagaucuucaagaugaagaaggggaagguggucaagagcguggagcucaacgcccccaacuaccacuacgaggagugcuccugcuaccccgacgccggcgagaucaugugcgugugccgcgacaacuggcacggcagcaaccggcccugggucuccuucaaccagaaccuggaguaccagaucggguacaucugcagcggcguguucggggacaacccgcgccccaacgacggcaccggguccugcggccccgugagccccaacggcgcguacgggaucaagggcuucuccuucaaguacgggaacggcgucuggaucgggcggaccaagagcacgaacucccgcagcggcuucgagauggugugggacccgaacggcuggaccgacaccgacuccgacuucagcaucaagcaggacaucgucgccaucaccgacugguccggguacagcggcagcuucgugcagcaccccgagcugacggggcucgacugcauccggcccugcuucuggguggagcugauccgcggccggcccaaggaguccaccaucuggaccagcggguccagcaucuccuucugcggcgucaacagcgagaccguguccuggagcuggccggacggcgccgagcugcccuucacgaucgacaaguga

SEQ ID NO: 87368 - RNA, 1350 nt, Artificial Sequence; identical to SEQ ID NO: 86995
  derived and/or modified sequence opt1 from neuraminidase__InfluenzaA__EPI164142

SEQ ID NO: 87369 - RNA, 1350 nt, Artificial Sequence
  derived and/or modified sequence opt1 from neuraminidase__InfluenzaA__EPI827076
augaaccccaaccagaagaucgugaccaucggcagcaucugcauggucaucgggaucaucucccugaugcuccagaucggcaacaucaucagcaucugggugucccacagcauccagaccgggaaccagcaccagacggagccgauccgcaacaccaacuuccugaccgagaacgccguggccuccgucacccuggcgggcaacagcucccucugccccaucaaggggugggccgugcacagcaaggacaacuccauccggaucggcagcaagggcgacguguucgucauccgcgagcccuucaucuccugcagccaccuggagugccggacguucuuccugacccagggggcccuccugaacgacaagcacuccaacggcaccgugaaggaccgcagcccccaccggacccugauguccugcccgaucggggaggcccccagccccuacaacucccgcuucgagagcguggccugguccgcgagcgccugccacgacggcacgagcuggcucaucaucgggaucuccggccccgacaacggcgccgucgccgugcugaaguacaacgggaucaucaccgacaccaucaagagcuggcggaacaacauccugcgcacccaggaguccgagugcgcgugcgugaacggcagcugcuucgccgucaugacggacgggccguccaacggccaggccagcuacaagaucuucaagaucgagaagggcaagguggugaaguccgucgagcucaacgcccccaacuaccacuacgaggagugcagcugcuaccccgacgccggggagaucaucugcgugugccgggacaacuggcacggcuccaaccgccccugggugagcuucaaccagaaccuggaguaccagaucggguacaucugcuccggcgucuucggggacaacccgcggcccaacgacggcaccggcagcugcgggcccguguccagcaacggcgcguacggggugaagggcuucuccuucaaguacgggaacggcgucuggaucggccgcaccaagagcacccacucccggagcggguucgagaugaucugggaccccaacggcuggacggggaccgacuccgaguucagcaugaagcaggacaucguggccaucaccgacuggagcggcuacuccgggagcuucgugcagcacccggagcugaccggccucgacugcauccgccccugcuucugggucgagcugauccggggccgccccaaggaguccacgaucuggaccagcggguccagcaucuccuucugcggcgugaacagcgacaccgucuccuggagcuggcccgacggggccgagcugccguucaccaucgacaaguga

SEQ ID NO: 87370 - RNA, 1350 nt, Artificial Sequence; identical to SEQ ID NO: 77587
  derived and/or modified sequence opt1 from neuraminidase__InfluenzaA__EPI168491

SEQ ID NO: 87371 - RNA, 1350 nt, Artificial Sequence
  derived and/or modified sequence opt1 from neuraminidase__InfluenzaA__EPI827078
augaaccccaaccagaagaucaucaccaucggcagcaucugcauggugaucgggaucgccucccugaugcuccagaucggcaacaucaucagcaucuggaucucccacagcauccagaccgggaaccagugccagaacgaguccaucagcaacacgaaguuccuggccgagaaggcggucgccuccgugacccuggccggcaacagcucccucugcccggugagcgggugggccgucuacuccaaggacaacagcauccgcaucggcuccaagggcgacguguucgugauccgggagcccuucaucagcugcucccaccuggagugccgcaccuucuuccugacccagggggcccuccugaacgacaagcacagcaacggcacggucaaggaccggagcccccaccgcacccugauguccugccccgugggggaggcgccgucccccuacaacagccgguucgagagcguggccugguccgccagcgccugccacgacggcaccuccuggcucaccaucgggaucagcggccccgacuccggcgcggucgccgugcugaaguacaacgggaucaucacggacaccaucaagagcuggcgcaacaacaucaugcggacccaggaguccgagugcgccugcgugaacggcagcugcuucaccaucaugacggacgggcccuccagcggccaggccuccuacaagaucuucaagauggagaagggcaaggucaucaagagcguggagcuggacgccccgaacuaccacuacgaggagugcuccugcuaccccgacgcgggggagaucacgugcgugugccgcgacaacuggcacggcagcaaccggcccuggaucuccuucaaccagaaccucgaguaccagaucggguacaucugcagcggcgucuucggggacaacccccgcccgaacgacggcaccggcuccugcgggcccguguuccccaacggcgccuacggggugaagggcuucagcuucaaguacgggaacggcgucuggaucggccggaccaaguccaccaacagccgcagcggguucgagaugaucugggaccccaacggcuggaccgggaccgacuccagcuucuccgugaagcaggacaucguggccaucaccgaguggagcggcuacuccgggagcuucguccagcacccggagcugacgggccuggacugcauccggcccugcuucuggguggagcucauccgcggccggcccaaggaguccaccaucuggaccagcggguccagcaucuccuucugcggcgugaacggggacaccgucagcugguccuggcccgacggcgccgagcugccguucacgaucgacaaguga

SEQ ID NO: 87372 - RNA, 1350 nt, Artificial Sequence
  derived and/or modified sequence opt1 from neuraminidase__InfluenzaA__EPI594521
augaaccccaaccagaagaucaucaccaucggcagcaucugcguggggaucggcaucgucucccugaugcuccagaucgggaacauggugagcaucugggugaaccacuccauccagaccgagaaccagugccaggccgagagcaucuccaacacgaaguuccugaccgagaaggccgucgcgccggugacccugaugggcaacagcucccucugccccaucagcgggugggccgugcacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcgcccugauguccugcccggucggggaggcccccucccccuacaacagccgguucgaguccguggcguggagcgccagcgccugccacgacggcaccggguggcucaccaucggcaucuccggccccgacaacggggccguggcgguccugaaguacaacggcaucaucacggacaccaucaagagcuggcgcaacaacauccugcggacccaggaguccgagugcgccugcgugaacgggagcugcuucaccgugaugacggacggcccguccaacggccaggccagcuacaagaucuucaagcucgagaaggggaaggucgugaaguccguggagcuggacgcccccaacuaccacuacgaggagugcagcugcuaccccgacgccggcgagaucacgugcgucugccgcgacaacuggcacggguccaaccggcccugggugagcuucaaccagaaccuggaguaccagaucggcuacaucugcuccgggguguucggcgacaacccgcgccccaacgacggcaccgggagcugcggccccgucucccccaacggggcguacggcgugaagggguucagcuucaaguacggcaacggcguguggaucgggcggaccaaguccaccaacagccgcuccggcuucgagaugaucugggacccgaacggguggaccgagaccgacagcuccuucagcgucaagcaggacaucguggccaucaccgacuggagcggcuacuccgggagcuucguccagcaccccgagcucacgggccuggacugcauccggcccugcuucuggguggagcugauccgcggccggcccaaggaguccaccaucuggaccagcggguccagcaucuccuucugcggcgugaacagcgacaccgucgggugguccuggccggacggcgccgaggugcccuucacgaucgacaaguga

SEQ ID NO: 87373 - RNA, 1410 nt, Artificial Sequence
  derived and/or modified sequence opt1 from neuraminidase__InfluenzaA__EPI5787
augaaccccaaccagaagaucaucaccaucggcagcaucugcaugguggucgggaucaucucccugaugcuccagaucggcaacaucaucagcaucugggugucccacagcauccagaccgggaaccagcaccaggccgagccgugcaaccaguccaucaucacguacgagaacaacaccugggugaaccagaccuacgucaacaucagcaacaccaacuuccugacggagaaggccguggcguccgugacccuggccggcaacagcucccucugccccaucagcgggugggccguccacuccaaggacaacggcauccgcaucggcagcaagggggacguguucgugauccgggagcccuucaucuccugcagccaccuggagugccgcaccuucuuccugacccagggcgcccuccugaacgacaagcacuccaacgggacggucaaggaccggagcccccaccgcacccugauguccugcccggugggcgaggcccccagccccuacaacucccgguucgagagcguggcguggagcgccuccgccugccacgacgggaccagcuggcucaccaucggcaucuccggccccgacaacggggccgucgcggugcugaaguacaacggcaucaucacggacaccaucaagagcuggcgcaacaacauccugcggacccaggaguccgagugcgccugcgugaacgggagcugcuucaccgucaugacggacggcccguccaacggccaggccagcuacaagaucuucaagauggagaaggggaagguggugaaguccgucgagcucaacgcccccaacuaccacuacgaggagugcagcugcuaccccgacgccggcgagaucacgugcgugugccgcgacaacuggcacggguccaaccggcccugggugagcuucaaccagaaccuggaguaccagaucggcuacaucugcuccggggucuucggcgacaacccgcgccccaacgacggcaccgggagcugcggccccgugucccccaacggggcguacggcgugaagggguucagcuucaaguacggcaacggcgucuggaucgggcggaccaaguccaccaacagccgcuccggcuucgagaugaucugggacccgaacggguggaccggcaccgacagcagcuucuccgugaagcaggacaucgucgccaucaccgacuggagcggguacuccggcagcuucgugcagcaccccgagcugacgggccucgacugcauccggcccugcuucuggguggagcugauccgcgggcggcccaaggaguccaccaucuggaccagcggcuccagcaucuccuucugcggggucaacagcgacaccgugggcugguccuggccggacgacgccgagcugcccuucacgaucgacaaguga

SEQ ID NO: 87374 - RNA, 1410 nt, Artificial Sequence; identical to SEQ ID NO: 87373
  derived and/or modified sequence opt1 from neuraminidase__InfluenzaA__EPI5787

SEQ ID NO: 87375 - RNA, 1350 nt, Artificial Sequence; identical to SEQ ID NO: 82073
  derived and/or modified sequence opt1 from neuraminidase__InfluenzaA__EPI267031

SEQ ID NO: 87376 - RNA, 1350 nt, Artificial Sequence; identical to SEQ ID NO: 83653
  derived and/or modified sequence opt1 from neuraminidase__InfluenzaA__EPI376539

SEQ ID NO: 87377 - RNA, 1350 nt, Artificial Sequence
  derived and/or modified sequence opt1 from neuraminidase__InfluenzaA__EPI124069
augaaccccaaccagaagaucaucaccaucggcagcaucugcauggugaucgggaucgucucccugaugcuccagaucggcaacaugaucagcaucugggugucccacagcauccagaccgggaaccagcaccaggccgaguccaucagcaacacgaacccgcugaccgagaaggccguggcguccgucacccuggccggcaacagcucccucugccccauccgcgggugggccgugcacagcaaggacaacaacauccggaucggcuccaagggcgacguguucgucauccgcgagcccuucaucagcugcucccaccuggagugccggaccuucuuccugacgcagggggcccuccugaacgacaagcacagcaacggcaccgugaaggaccgcagcccccaccggacccugauguccugcccggugggggaggcccccucccccuacaacagccgcuucgaguccgucgcguggagcgccagcgccugccacgacggcaccuccuggcucacgaucgggaucagcggccccgacaacgaggccguggcggugcugaaguacaacggcaucaucaccgacaccaucaaguccuggcggaacaacauccugcgcacccaggagagcgagugcgccugcgucaacggguccugcuucacggugaugaccgacggcccgagcgacgggcaggccuccuacaagaucuucaagauggagaagggcaagguggucaagagcguggagcucgacgcccccaacuaccacuacgaggagugcuccugcuaccccgacgccggcgagaucacgugcgugugccgggacaacuggcacgggagcaaccgccccugggucuccuucaaccagaaccuggaguaccagaucggcuacaucugcagcgggguguucggcgacaacccgcggcccaacgacgggaccggcuccugcggccccaugagccccaacggggcguacggcgugaagggguucuccuucaaguacggcaacggggucuggaucggccgcaccaagagcaccaacucccggagcggcuucgagaugaucugggacccgaacggguggaccggcaccgacuccagcuucagcgugaagcaggacaucguggccaucacggacugguccggguacagcggcuccuucguccagcaccccgagcugaccgggcucgacugcauccgccccugcuucuggguggagcugauccggggccgccccaaggagagcaccaucuggaccuccggcagcuccaucagcuucugcggggucaacuccgacacggugagcugguccuggccggacggcgccgagcugcccuucaccaucgacaaguga

SEQ ID NO: 87378 - RNA, 1350 nt, Artificial Sequence
  derived and/or modified sequence opt1 from neuraminidase__InfluenzaA__EPI342499
augaaccccaaccagaagaucaucaccaucggcagcaucugcauggugaucgggaucgucucccugaugcuccagaucggcaacaugaucagcaucuggaucucccacagcauccagaaggggaaccagcaccgcaccgaguccaucagcaacacgaacccgcugaccgagaaggccguggccuccgugacccugaccggcaacagcucccucugccccauccgggggugggcgguccacagcaaggacaacaacauccgcaucggcuccaagggcgacguguucgugauccgggagcccuucaucagcugcucccaccuggagugccgcacguucuuccugacccagggggcccuccugaacgacaagcacagcaacggcaccgucaaggaccggagcccccaccgcacccugauguccugcccgcucggggaggcccccucccccuacaacagccgguucgaguccguggccuggagcgccagcgcgugccacgacggcacgggguggcugaccaucggcaucuccggccccgacaacgaggccguggccguccugaaguacaacgggaucaucaccgacaccaucaagagcuggcgcaacaacauccuccggacgcaggaguccgagugcgccugcgugaacggcagcugcuucaccgugaugaccgacgggccguccaacggccaggcgagcuacaagaucuucaagaugcgcaagggcaaggucgugaaguccguggagcuggacgcccccaacuaccacuacgaggagugcagcugcuaccccgacaccggggagaucacgugcgucugccgggacaacuggcacggcuccaaccgccccuggaucagcuucaaccagaaccuggaguaccagaucggguacaucugcuccggcaucuucggggacaacccgcggcccaacgacggcaccggcagcugcgggcccaugucccccaacggcgccuacggggugaagggcuucagcuucaaguacgggaacggcguguggaucggccgcaccaaguccaccaacagccgguccggguucgagaugaucugggacccgaacggcuggacggagaccgacagcuccuucagcgucaagcaggacaucguggccaucaccgacuggagcggguacuccggcagcuucgugcagcaccccgagcucaccgggcuggacugcauccgccccugcuucugggucgagcugauccggggccgccccaaggaguccacgaucuggaccagcggcuccagcaucuccuucugcggggugaacagcgacaccguguccuggagcuggccggacggcgccgagcuccccuucaccaucgacaaguga

SEQ ID NO: 87379 - RNA, 1350 nt, Artificial Sequence
  derived and/or modified sequence opt1 from neuraminidase__InfluenzaA__EPI103069
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccaucaaggaccggagcccccaccgcacccugauguccugcccggugggggaggcccccagccccuacaacucccgguucgagagcguggcguggagcgccuccgccugccacgacggcaccagcuggcucacgaucgggaucuccggccccgacaacggcgccgucgcggugcugaaguacaacgggaucaucaccgacaccaucaagagcuggcgcaacaacauccugcggacccaggaguccgagugcgccugcgugaacggcagcugcuucacggucaugaccgacgggccguccagcggccaggccuccuacaagaucuucaagauggagaagggcaagguggucaagagcguggagcucgacgcccccaacuaccacuacgaggagugcuccugcuaccccgacgccggggagaucacgugcgugugccgcgacaacuggcacggcagcaaccggcccuggguguccuucaaccagaaccuggaguaccagaucggguacaucugcagcggcgucuucggggacaacccgcgccccaacgacggcaccggcuccugcgggcccgugagccccaacggcgcguacggggugaagggcuucuccuucaaguacgggaacggcgucuggaucggccggaccaagagcaccaacucccgcagcggguucgagaugaucugggacccgaacggcuggaccgggaccgacagcuccuucagcgugaagcaggacaucguggccaucacggacugguccggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacggggccgagcugcccuucaccaucgacaaguga

SEQ ID NO: 87380 - RNA, 1350 nt, Artificial Sequence; identical to SEQ ID NO: 87356
  derived and/or modified sequence opt1 from neuraminidase__InfluenzaA__EPI227595

SEQ ID NO: 87381 - RNA, 1410 nt, Artificial Sequence
  derived and/or modified sequence opt1 from neuraminidase__InfluenzaA__EPI569385
augaaccccaaccagaagaucaucaccaucggcagcgugucccugaccaucgccacggucugcuuccucaugcagaucgccauccuggcgaccaccgugacccugcacuucaagcagaacgagugcagcaucccgcccaacaaccaggugguccccugcgagcccaucaucaucgagaagaacaucacggagaucguguaccucaacaacaccaccaucgagaaggaggugugcccggagguccccgaguaccgcaacugguccaagccccagugccagaucaccggguucgcccccuucagcaaggacaacuccauccggcugagcgccggcggggacaucugggugacgcgcgagccguacguguccugcagccccggcaagugcuaccaguucgcccuggggcagggcaccacccucaacaacaagcacuccaacggcaccauccacgaccggaucccccaccgcacgcugcugaugagcgagcucgggguccccuuccaccugggcaccaagcaggucugcaucgccugguccagcuccagcugccacgacgggaaggcguggcugcacgugugcgugaccggcgacgaccggaacgccaccgccuccuucaucuacgacgggaugcucgccgacagcaucggcuccuggagccagaacauccugcgcacgcaggaguccgagugcgugugcaucaacgggaccugcaccguggucaugaccgacgggagcgcgagcggccgggccgacacgcgcauccuguucaucaaggaggggaagaucgugcacaucuccccgcucagcggcuccgcccagcacaucgaggagugcagcugcuacccccgguaccccgacgugcgcugcgucugccgggacaacuggaagggcuccaaccgccccgugaucgacaucaacauggccgacuacagcaucgacuccagcuacgugugcuccgggcuggucggcgacaccccgcggaacgacgacagcuccagcuccagcaacugccgcgaccccaacaacgagcgggggaaccccggcgugaaggggugggccuucgacaacggcaacgacguguggaugggccgcaccaucuccgaggacagccgguccggguacgagaccuuccgcgucacggacggcuggaccaccgcgaacagcaagucccaggugaaccggcagaucaucgucgacaacaacaacuggagcggguacagcggcaucuucuccguggagggcaagagcugcaucaaccgcugcuucuacguggagcugauccggggccgcccccaggagacccgcgucugguggacguccaacagcaucgugguguucugcggcaccuccgggaccuacggcaccgggagcuggccggacggcgccaacaucaacuucaugcccaucuga

SEQ ID NO: 87382 - RNA, 1380 nt, Artificial Sequence
  derived and/or modified sequence opt1 from neuraminidase__InfluenzaA__EPI736916
augaaccccaaccagaagaucacgugcaucagcgccaccggcgugacccuguccgucgugagccuccugaucgggaucgccaaccugggccucaacaucgggcugcacuacaagguguccgacagcaccaccaucuccaucccgaacaugaacgagaccaaccccacgaccaccaacaucaccaacaucaucgucaacaagaacgaggagcgcacguuccugaaccucaccaagccccugugcgaggugaacagcuggcacauccuguccaaggacaacgcgauccggaucggcgaggacgcccacauccucgugacccgcgagcccuaccugagcugcgacccgcaggggugccggauguucgcccugucccagggcaccacgcuccgcggccggcacgccaacgggaccauccacgaccgcagccccuuccgggcccugaucuccugggagaugggccaggcgcccagccccuacaacacccgcgucgagugcaucgggugguccagcaccuccugccacgacggcaucagccggauguccaucugcaucagcgggccgaacaacaacgccuccgccguggugugguaccgcggccggcccgucacggagauccccagcugggccggcaacauccugcgcacccaggagagcgagugcgugugccacaaggggaucugccccguggucaugaccgacggcccggcgaacaacaaggccgccaccaagaucaucuacuucaaggaggggaaggugcagaagaucgaggagcuccagggcaacgcccagcacaucgaggagugcuccugcuacggcgccgcggggaugaucaagugcgugugccgggacaacuggaagggcgccaaccgccccaucaucacgaucgaccccgagaugaugacccacaccagcaaguaccugugcuccaagauccugaccgacacgagccggcccaacgacccgaccaacgggaacugcgacgcccccaucaccggcgggucccccgaccccggcgucaagggcuucgccuuccucgacggggagaacagcuggcugggccgcaccaucuccaaggacagccgguccggguacgagaugcugaaggugccgaacgccgagacggacacccagagcggccccaccuccuaccagcucaucgugaacaaccagaacuggagcggguacuccggcgcguucaucgacuacugggccaacaaggagugcuucaaccccugcuucuacgucgagcugauccgcggccggcccaaggagagcgacgugcuguggaccuccaacagcaugguggcccucugcgggucccgcgagcggcugggcagcugguccuggcacgacggggccgagaucaucuacuucaaguga

SEQ ID NO: 87383 - RNA, 1380 nt, Artificial Sequence; identical to SEQ ID NO: 87002
  derived and/or modified sequence opt1 from neuraminidase__InfluenzaA__EPI593891

SEQ ID NO: 87384 - RNA, 1380 nt, Artificial Sequence
  derived and/or modified sequence opt1 from neuraminidase__InfluenzaA__EPI691380
augaaccccaaccagaagaucgugugcaucagcgucaccggcgugacccuguccguggucagccuccugaucgggaucacgaaccugggccucaacaucgggcugcacuacaagguguccgacagcaccaccaucaacaucccgaacaugaacgagaccaaccccacgaccaccaacaucaccaacaucaucaugaacaagaacgaggagcgcacguuccugaagcucaccaagccccugugcgaggugaacuccuggcacauccugagcaaggacaacgccauccggaucggcgaggacgcccacauccucgucacccgcgagcccuaccuguccugcgacccgcaggggugccggauguucgcgcugagccagggcaccacgcuccgcggccagcacgccaacgggaccauccacgaccggucccccuuccgcgcccugaucagcugggagaugggccaggcccccucccccuacaacacccggguggagugcaucggguggagcuccaccagcugccacgacggcaucucccgcaugagcaucugcaucuccgggccgaacaacaacgccagcgcgguggucugguaccggggccgccccgugacggagauccccuccugggccggcaacauccugcggacccaggagagcgagugcgugugccacaaggggaucugccccgucgugaugaccgacggcccggccaacaacaaggccgcgaccaagaucaucuacuucaaggaggggaagauccagaagacggaggagcuccagggcaacgcccagcacaucgaggagugcagcugcuacggcgccgccgggaugaucaagugcgugugccgcgacaacuggaagggcgccaaccggcccaucaucaccaucgaccccgagaugaugacccacaccuccaaguaccugugcagcaagauccugacggacaccucccgccccaacgacccgaccaacgggaacugcgacgcgcccaucaccggcgggagccccgaccccggcgucaagggcuucgccuuccucgacggggagaacuccuggcugggccggacgaucagcaaggacucccgcagcggguacgagaugcugaaggugccgaacgccgagaucgacauccaguccggccccaucagcuaccagcucguggucaacaaccagaacugguccggguacagcggcgccuucaucgacuacugggccaacaaggagugcuucaaccccugcuucuacguggagcugauccggggccgccccaaggaguccggggugcuguggaccagcaacuccauggucgcgcucugcggcagccgggagcgccugggguccuggagcuggcacgacggcgccgagaucaucuacuucaaguga

SEQ ID NO: 87385 - RNA, 1413 nt, Artificial Sequence
  derived and/or modified sequence opt1 from neuraminidase__InfluenzaA__EPI533584
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaacaugaacgagaccucccccaccacgaccaucaucaacaaccacccccagaacaacuucaccaacaucaccaacaucaucgugacgaagaacgaggagggccaccuccugaaccugaccaagccccugugcgaggucaacagcuggcacauccuguccaaggacaacgcgauccgcaucggggaggacgcccacaucaucgugacccgggagccguaccucagcugcgacccccagggcugccgcauguucgcccugucccagggcaccacgcugcgggggaagcacgccaacggcaccauccacgaccgcagccccuuccgggcccucguguccugggagauggggcaggcgcccagcccguacaacacccgcgucgagugcaucggcugguccagcaccuccugccacgacgggaucagccggauguccaucugcaucagcggccccaacaacaacgccuccgccguggugugguacggcgggcgccccgucacggagauccccagcugggccggcaacauccugcggacccaggagagcgagugcgugugccacgggggcaucugcccgguggucaugaccgacggccccgcgaacaaccgcgccgagaccaagaucaucuacuucaaggaggggaagaucaagaagaucgaggagcugaagggcgacgcccagcacaucgaggagugcuccugcuacggggccagcgagaugaucaagugcaucugccgggacaacuggaagggcgccaaccgccccgugaucacgaucgaccccgagaugaugacccacaccuccaaguaccucugcagcaagauccugaccgacacgucccggccgaacgaccccaccaacgggaagugcgaggcgcccaucaccggcggcagccccgacccgggggugaagggcuucgccuuccuggacggggagaacuccuggcucggccgcaccaucagcaaggacucccggagcggguacgagaugcugaagguccccaacgccgagacggacacccaguccggcgccaucagccaccagaucaucgugaacaaccagaacugguccggcuacagcggggccuucaucgacuacugggcgaacaaggagugcuucaaccccugcuucuacguggagcugauccgcggccggcccaaggaguccagcguccucuggaccuccaacagcaucguggcccugugcggguccaaggagcgccugggcagcuggagcuggcacgacggggccgagaucaucuacuucaaguga

SEQ ID NO: 87386 - RNA, 1380 nt, Artificial Sequence; identical to SEQ ID NO: 87006
  derived and/or modified sequence opt1 from neuraminidase__InfluenzaA__EPI641400

SEQ ID NO: 87387 - RNA, 1380 nt, Artificial Sequence; identical to SEQ ID NO: 87006
  derived and/or modified sequence opt1 from neuraminidase__InfluenzaA__EPI587620

SEQ ID NO: 87388 - RNA, 1410 nt, Artificial Sequence
  derived and/or modified sequence opt1 from neuraminidase__InfluenzaA__EPI569392
augaaccccaaccagaagaucgugaccaucggcagccugucccucgggcuggucguguucaacgugcugcuccacgccgucagcaucauccugaccgugcuggcccucggcaaguccgagaacaacgggaucugcaacggcacggugguccgcgaguacaacgagaccgugcggaucgagaaggugacccagugguacaacaccagcgucguggaguacgugccgcacuggaacgaggggacguacaucaacaacaccgagcccaucugcgacgucaagggcuucgcgcccuucuccaaggacaacggcauccgcguggggagccggggccacaucuucgugauccgcgagcccuucgucuccugcagcccgguggggugccggaccuucuuccugacccagggcucccugcucaacgacaagcacagcaacgggacggugaaggaccgcucccccuuccggacccugaugagcgucgaggugggccagucccccaacguguaccaggcccgcuucgaggccgucgccuggagcgccaccgcgugccacgacggcaagaaguggauggccaucggggugaccggccccgacuccaaggccguggccgucgugcacuacgggggcgucccgacggacguggugaacagcugggcgggcgacauccugcggacccaggaguccagcugcacgugcauccaggggaacugcuacugggucaugaccgacggccccgccaaccgccaggcccaguaccggaucuacaaggccaaccaggggaagaucaucggccgcaaggacguguccuucagcgggggccacaucgaggagugcagcugcuaccccaacgacggcaagguggagugcgucugccgggacaacuggaccgggaccaaccgccccgugcucaucaucuccccggaccugagcuaccgggugggcuaccugugcgccgggcuccccuccgacacgccccgcggcgaggacacccaguucgucgggagcugcaccucccccaugggcaaccagggcuacggggugaagggcuucggguuccggcagggcaccgacgugugggucgggcgcaccaucagccggaccucccgcagcggcuucgagaucauccggaucaagaacggcuggacgcagaccuccaaggagcagauccgccgccaggugguggucgacaacagcaacugguccggguacagcggcuccuucacccugccgguggagcugagcgggcgggagugccucgugcccugcuucugggucgagaugauccgcggccggcccgaggagcgcaccaucuggacguccagcuccagcaucgugaugugcggcguggacuacgagaucgcggacugguccuggcacgacggggccauccugcccuucgacaucgacaaguga

SEQ ID NO: 87389 - RNA, 1368 nt, Artificial Sequence
  derived and/or modified sequence opt1 from neuraminidase__InfluenzaA__EPI459857
augaaccccaaccagaagaucaucaccaucggcagcaucugcauggugaucgggaccgucucccugaucguccaggugggcaacaucauccucaucugggugaaccacagcauccagacgugcaucaccuacgagaacaacaccugggugaaccagaccuacguguccaacacgaacuuccugaccgggcaggccgucgccagcgugacccuggcgggcaacuccagccucugcccgaucuccgggugggccaucuacagcaaggacaacggcauccgcaucggcuccaagggggacguguucgucauccgggagcccuucaucagcugcucccaccuggagugccgcaccuucuuccugacgcagggcgcccuccugaacgacaagcacagcaacgggaccaucaaggaccggucccccuaccgcacccugaugagcugccccgugggcgaggccccgucccccuacaacagccgguucgaguccguggccuggagcgcguccgccugccacgacgggaucaacuggcucaccaucggcaucagcggccccgacaacgaggccgucgccgugcugaaguacaacggggugaucacggacaccaucaagagcuggcgcaacaacauccugcggacccaggaguccgagugcgcgugcgucaacggcagcugcuucaccgugaugacggacgggcccuccaacggccaggccagcuacaagaucuucaagaucgagaagggcaaggugguccgcuccguggagcucgacgccccgaacuaccacuacgaggagugcagcugcuaccccgacgccggggagaucacgugcgugugccgggacaacuggcacggcuccaaccgccccugggucagcuucaaccagaaccuggaguaccagaccggguacaucugcuccggcguguucggggacagcccccggccgaacgacggcaccggcuccugcgggcccgugagcuccaacggcgccuucggggucaagggcuucagcuucaaguacgggaacggcguguggaucggccgcaccaagaccaccaacucccggagcggguucgagaugaucugggaccccaacggcuggaccgagacggacuccagcuucuccaugaagcaggacaucaucgcgaucaccgacuggagcggguacagcggcuccuucguccagcaccccgagcugaccgggcucaacugcaugcgcccgugcuucuggguggagcugauccggggccagccccgcgagaacaccaucuggacgagcggcuccagcaucuccuucugcggggugaacagcgagaccgucggcugguccuggcccgacggggccgagcugcccuucaccaucgacaaguga

SEQ ID NO: 87390 - RNA, 1416 nt, Artificial Sequence
  derived and/or modified sequence opt1 from neuraminidase__InfluenzaA__EPI242204
augaaccccaaccagaagcuguucgcccucagcggcguggccaucgcgcuguccguccugaaccuccugaucgggaucagcaacgugggccugaacgugucccuccaccugaagggggagggcgucaagcaggagaacaaccugaccugcaccacgaucacccagaacaacaccaccgugguggagaacacguacgucaacaacaccaccaucaucaacaaggggaccaaccucaaggccccgaacuaccugcugcucaacaagagccugugcuccguggagggcuggguggucaucgccaaggacaacgccauccgcuucggcgagagcgagcagaucaucgugacgcgggagcccuacguguccugcgaccccagcgggugcaagauguacgcccugcaccagggcaccaccauccgcaacaagcacuccaacgggaccauccacgaccggacgaccuuccgcggccucaucagcacgccccuggggaccccgcccaccgucuccaacagcgacuucaucugcgugggcugguccagcaccuccugccacgacggcguggggcggaugaccaucugcauccagggcaacaacgacaacgcgaccgccacggucuacuacaaccgccggcugaccaccaccaucaagacgugggccaagaacauccuccgcacccaggagagcgagugcgugugccacaacgggaccugcgccguggucaugaccgacggccccgcguccagccaggccuacacgaagaucauguacuuccacaagggccugaucaucaaggaggagccccugcggggguccgcccgccacaucgaggagugcagcugcuacggccacgaccagaaggugagcugcgugugccgggacaacuggcagggggccaaccgcccgaucaucgagaucgacauguccacccucgagcacaccagccgguacgucugcaccggcgugcugacggacaccucccgccccggggacaagcccaacggcgacugcagcaaccccaucaccggcuccccgggggcccccggcgugaagggguucggcuuccugaacggggacaacaccuggcucggccggacgaucagcccccgcucccggagcggcuucgagaugcugaagauccccaacgcggagaccgacccgaacucccgcaucaucgagcggcaggagaucgucgacaacagcaacugguccggguacagcggcuccuucaucgacuacugggacgaggccaacgagugcuacaaccccugcuucuacguggagcugauccgcgggcggcccgaggaggccaaguacgucugguggaccagcaacucccucaucgcccugugcggcagccccguguccguggggagcggcuccuucccggacggcgcccagauccaguacuucagcuga

SEQ ID NO: 87391 - RNA, 1416 nt, Artificial Sequence
  derived and/or modified sequence opt1 from neuraminidase__InfluenzaA__EPI408029
augaaccccaaccagaagcuguucgcccucagcggcguggccaucgcgcuguccguccugaaccuccugaucgggaucagcaacgugggccugaacaugucccuccaccugaagggggagggcgugaagcaggagaacaaccugaccugcaccacgaucacccagaacaacaccaccgucguggagaacacguacgugaacaacaccaccaucaucaacaaggggaccaaccucaaggccccgaacuaccugcugcucaacaagagccugugcuccgucgagggcuggguggugaucgccaaggacaacgccauccgcuucggcgagagcgagcagaucaucgucacgcgggagcccuacguguccugcgaccccagcgggugcaagauguacgcccugcaccagggcaccaccauccgcaacaagcacuccaacgggaccauccacgaccggacgaccuuccgcggccuccugagcacgccccuggggaccccgcccaccguguccaacagcgacuucaucugcgucggcugguccagcaccuccugccacgacggcguggggcggaugaccaucugcauccagggcaacaacgacaacgcgaccgccacgguguacuacaaccgccggcucaccaccaccaucaagacgugggccaagaacauccugcgcacccaggagagcgagugcgucugccacaacgggaccugcgccguggugaugaccgacggccccgcguccagccaggccuacacgaagaucauguacuuccacaagggccugaucaucaaggaggagccccuccggggguccgcccgccacaucgaggagugcagcugcuacggccacgaccagaaggucagcugcgugugccgggacaacuggcagggggccaaccgcccgaucaucgagaucgacauguccacccuggagcacaccagccgguacgugugcaccggcguccugacggacaccucccgccccggggacaagcccaacggcgacugcagcaaccccaucaccggcuccccgggggcccccggcgugaagggguucggcuuccucaacggggacaacaccuggcugggccggacgaucagcccccgcucccggagcggcuucgagaugcugaagauccccaacgcggagaccgacccgaacucccgcaucaucgagcggcaggagaucguggacaacagcaaccgcuccggguacagcggcuccuucaucgacuacugggacgaggccaacgagugcuacaaccccugcuucuacgucgagcucauccgggggcgccccgaggaggccaaguacgugugguggaccagcaacucccugaucgcccugugcggcagccccgucuccguggggagcggcuccuucccggacggcgcccagauccaguacuucagcuga

SEQ ID NO: 87392 - RNA, 1398 nt, Artificial Sequence; identical to SEQ ID NO: 84462
  derived and/or modified sequence opt1 from neuraminidase__InfluenzaA__EPI439509

SEQ ID NO: 87393 - RNA, 1350 nt, Artificial Sequence; identical to SEQ ID NO: 86995
  derived and/or modified sequence opt1 from neuraminidase__InfluenzaA__EPI164223

SEQ ID NO: 87394 - RNA, 1398 nt, Artificial Sequence; identical to SEQ ID NO: 84462
  derived and/or modified sequence opt1 from neuraminidase__InfluenzaA__EPI486493

SEQ ID NO: 87395 - RNA, 1398 nt, Artificial Sequence
  derived and/or modified sequence opt1 from neuraminidase__InfluenzaA__EPI740737
augaaccccaaccagaagauccugugcaccagcgccaccgccaucacgaucuccgcgaucgccgugcucaucggcaucgccaaccuggggcugaacaucggccuccaccugaagccggggugcaacugcagccacucccagcccgagaccaccaacaccagccagacgaucaucaacaacuacuacaacgagaccaacaucaccaacauccagaucgaggagcgcaccucccggaacuucaacaaccugacgaagggccucugcaccaucaacagcuggcacaucuacgggaaggacaacgccguccgcaucggcgaguccagcgacgugcuggugacccgggagcccuacgucuccugcgaccccgacgagugccgcuucuacgcccugagccagggcaccacgauccgggggaagcacuccaacggcaccauccacgaccgcagccaguaccgggcgcucaucuccuggccgcugagcuccccgcccaccgugcacaacagccgcguggagugcaucgggugguccagcaccuccugccacgacggcaagagccggaugagcaucugcaucuccgggcccaacaacaacgccagcgccgucgugugguacaaccgccggcccguggccgagaucaacacgugggcgcgcaacauccugcggacccaggaguccgagugcgucugccacaacggcgugugccccguggucuucaccgacggccccgccaccgggcccgccgacacgcgcaucuacuacuucaaggagggcaagauccucaagugggagagccugaccgggaccgccaagcacaucgaggagugcuccugcuacggcgagcggaccggcaucacgugcacgugccgcgacaacuggcaggggagcaaccggccgguggugcagaucgaccccgucgccaugacccacaccucccaguacaucugcagccccgugcugaccgacagcccccgcccgaacgaccccaacaucggcaagugcaacgaccccuaccccgggaacaacaacaacggcgugaagggguucuccuaccucgacggcgcgaacaccuggcugggccggaccaucuccaccgccagccgcuccggguacgagaugcugaaggucccgaacgcccucacggacgaccggagcaagcccauccagggccagaccaucgugcugaacgccgacugguccggguacagcggcuccuucauggacuacugggccgagggggacugcuaccgcgcgugcuucuacguggagcugauccgcggccggcccaaggaggacaaggucugguggaccagcaacuccaucgugagcaugugcagcuccaccgaguuccucggccaguggaacuggcccgacggggccaagaucgaguacuuccuguga

SEQ ID NO: 87396 - RNA, 1398 nt, Artificial Sequence
  derived and/or modified sequence opt1 from neuraminidase__InfluenzaA__EPI730494
augaaccccaaccagaagauccugugcaccagcgccaccgccaucacgaucggcgcgaucgccgugcucaucgggaucgccaaccugggccugaacaucgggcuccaccugaagccgggcugcaacugcucccacagccagcccgagaucaccaacaccucccagaccaucaucaacaacuacuacagcgagacgaacaucaccaacauccagauggaggagcgcaccuccaagaacuucaacaaccugaccaaggggcucugcacgaucaacagcuggcacaucuacggcaaggacaacgccguccggaucggcgaguccagcgacgugcuggugacccgcgagcccuacgucuccugcgaccccgacgagugccgguucuacgcccugagccaggggaccaccauccgcggcaagcacuccaacgggacgauccacgaccggagccaguaccgcgcgcucaucuccuggccgcugagcuccccgcccaccguguacaacagccggguggagugcaucggcugguccagcaccuccugccacgacggcaagagccgcaugagcaucugcaucuccgggcccaacaacaacgccagcgccgucgugugguacaaccggcgccccguggccgagaucaacaccugggcgcggaacauccugcgcacgcaggaguccgagugcgucugccacaacggcgugugccccguggucuucaccgacgggagcgccaccggccccgccgacacccggaucuacuacuucaaggaggggaagauccucaagugggagucccugacgggcaccgccaagcacaucgaggagugcagcugcuacggcgagcgcaccgggaucacgugcacgugccgggacaacuggcagggcuccaaccgccccgugauccagaucgacccgguggccaugacccacaccagccaguacaucugcucccccguccugaccgacaacccccggcccaacgacccgaacaucgggaagugcaacgaccccuaccccggcaacaacaacaacgggaucaagggcuucagcuaccucgacggcgcgaacaccuggcuggggcgcaccaucuccaccgccagccgguccggcuacgagaugcugaaggugcccaacgcccucaccgacgaccgcagcaagccgauccaggggcagacgaucgugcugaacgccgacugguccggcuacagcggguccuucauggacuacugggccgagggcgacugcuaccgggcgugcuucuacgucgagcugauccgcggccgccccaaggaggacaaggugugguggaccagcaacuccaucgugagcaugugcagcuccaccgaguuccucgggcaguggaacuggcccgacggcgccaagaucgaguacuuccuguga

SEQ ID NO: 87397 - RNA, 1398 nt, Artificial Sequence
  derived and/or modified sequence opt1 from neuraminidase__InfluenzaA__EPI712925
augaaccccaaccagaagauccugugcaccagcgccaccgccaucacgaucggcgcgaucgccgugcucaucgggaucgccaaccugggccugaacaucgggcuccaccugaagccgggcugcaacugcucccacagccagcccgagaccaccaacaccucccagacgaucaucaacaacuacuacaacgagaccaacaucaccaacauccagaucgaggagcgcaccagccggaacuucaacaaccugacgaaggggcucugcaccaucaacuccuggcacaucuacggcaaggacaacgccguccgcaucggcgagagcuccgacgugcuggugacccgggagcccuacgucagcugcgaccccgacgagugccgcuucuacgcccugucccaggggaccacgauccggggcaagcacagcaacgggaccauccacgaccgcucccaguaccgggcgcucaucagcuggccgcuguccagcccgcccaccgugcacaacucccgcguggagugcaucggcuggagcuccaccagcugccacgacgggaagucccggaugagcaucugcaucagcggccccaacaacaacgccuccgccgucgugugguacaaccgccggcccguggccgagaucaacacgugggcgcgcaacauccugcggacccaggagagcgagugcgucugccacaacggcgugugccccguggucuucaccgacgggcccgccaccggccccgccgacacgcgcaucuacuacuucaaggaggggaagauccucaagugggagucccugaccggcaccgccaagcacaucgaggagugcagcugcuacggcgagcggaccgggaucacgugcacgugccgcgacaacuggcagggcuccaaccggccgguggugcagaucgaccccgucgccaugacccacaccagccaguacaucugcucccccgugcugaccgacagcccccgcccgaacgaccccaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggucccgaacgcccucacggacgaccgguccaagcccauccaggggcagaccaucgugcugaacgccgacuggagcggcuacuccgggagcuucauggacuacugggccgagggcgacugcuaccgcgcgugcuucuacguggagcugauccgcggccggcccaaggaggacaaggucugguggaccuccaacagcaucguguccaugugcagcagcaccgaguuccucgggcaguggaacuggcccgacggcgccaagaucgaguacuuccuguga

SEQ ID NO: 87398 - RNA, 1398 nt, Artificial Sequence
  derived and/or modified sequence opt1 from neuraminidase__InfluenzaA__EPI448938
augaaccccaaccagaagauccugugcaccagcgccaccgccaucaucaucggcgcgaucgccgugcucaucgggauggccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccuguga

SEQ ID NO: 87399 - RNA, 1410 nt, Artificial Sequence
  derived and/or modified sequence opt1 from neuraminidase__InfluenzaA__EPI445995
augaaccccaaccagaagaucaucgcccugggcagcgccucccucaccaucgcgaucaucugccugcugauccagaucgccauccucgccaccacgaugacccugcacuucaugcagaacgagcacaccaacagcacccgcaacaagguggucccgugcgaguccaucaucaucgagcggaacaucacggagaucgugcaccugaacgggaccaucaucgagaaggagagcugccccaaggccguggaguacaagaacugguccaagccccagugccagaucaccggcuucgcccccuucagcaaggacaacuccauccgccucagcgccgggggcgacaucugggucacccgggagccguacguguccugcagccuguccaagugcuaccaguucgcgcuggggcagggcacgacccucaacaaccgccacagcaacggcaccacccacgaccggucccccuaccgcacgcugcugaugagcgagcucggggugcccuuccaccugggcaccaagcaggucugcaucgccugguccagcuccagcugccacgacgggcgggccuggcugcacgugugcgugaccggcgacgacaagaacgcgaccgccuccgucaucuacgggggcaugcucacggacagcaucggcagcugguccaagaacauccugcgcacccaggagagcgagugcgugugcaucaacgggaccugcaccguggucaugacggacggcuccgccagcgggcgggccgacacccgcauccuguucauccgggagggcaagaucgugcacaucagcccccucuccggcuccgcccagcacguggaggagugcagcugcuacccgcgcuaccccgagguccggugcgugugccgcgacaacuggaagggguccaaccggcccgugcuguacaucaacgucgcggacuacagcaucgacuccagcuacgugugcuccggccuggugggggacacgccccgcaacgaggacagcuccagcuccagcaacugccgggacccgaacaacgagcgcggcgggcccggcgucaagggcugggccuucgacaacggggacgacguguggaugggccggaccaucaagaaggacucccgcgccggguacgagaccuuccggguggucgacggcuggacccucgccaacagcaagagccagaccaaccgccaggugaucgucgacuccgacaacuggagcggguacuccggcauguucagcguggagggcaagaccugcaucaaccgcugcuucuacguggagcugauccgggggcgcccccaggagacgcgggucugguggaccuccaacagcaucaucguguucugcggcaccuccgggaccuacggcacggggagcuggcccgacggcgccgacaucaacuucauguccaucuga

SEQ ID NO: 87400 - RNA, 1410 nt, Artificial Sequence
  derived and/or modified sequence opt1 from neuraminidase__InfluenzaA__EPI470861
augaaccccaaccagaagaucaucgccaucggcagcgugucccugaccaucgccaccaucugccuccugaugcagaucgcgauccuggccacgaccaugacccuccacuucaagcagaacgagugcaucaacagcuccaacaaccaggucgugccgugcgagcccaucaucaucgagcgcaacaucaccgagaucgugcaccugaacagcacgacccuggagaaggagaucugccccaaggucgccgacuaccggaacugguccaagccccagugccagaucaccggguucgccccguucagcaaggacaacuccauccgccucagcgccggcggggacaucugggugacccgggagcccuacguguccugcggccuggggaagugcuaccaguucgcgcugggccagggcacgacccucgagaacaagcacagcaacgggaccgcccacgaccgcacgccccaccggacccugcugaugaacgagcucggcguccccuuccaccuggccaccaagcaggucugcaucgccugguccagcuccagcugccacgacgggaaggcguggcugcacgugugcgugaccggcgacgaccgcaacgccaccgccuccaucaucuacgacgggauccucguggacagcaucggcuccuggagcaagaacauccugcggacgcaggaguccgagugcgugugcaucaacgggaccugcgccgucgugaugaccgacggcagcgccagcggccgcgcggacacccggauccuguucauccgcgaggggaagaucgcccacaucuccccgcucagcggcuccgcccagcacguggaggagugcagcugcuacccccgguaccccgagguccgcugcgugugccgggacaacuggaagggcuccaaccgccccgugcuguacaucaacauggccaacuacagcaucgacuccagcuacgucugcuccgggcuggugggcgacacgccgcggaacgacgaccgcagcuccagcuccaacugccgggaccccaacaacgagcgcggggcccccggcgugaaggggugggcguucgacaacggcaacgacaucuggaugggccggaccaucaagaaggacagccgcuccggguacgagaccuuccgggucaucggcggguggaccacggccaacagcaagucccagaucaaccgccaggugaucguggacagcgacaacuccagcggcuacagcgggaucuucuccgucgagggcaagagcugcaucaaccgcugcuucuacguggagcucauccggggccgccccaaggagacccgggucugguggaccuccaacagcaucaucguguucugcgggaccuccggcacguacgggaccggcagcuggccggacggggccaacaucaacuucaugcccaucuga

SEQ ID NO: 87401 - RNA, 1401 nt, Artificial Sequence
  derived and/or modified sequence opt1 from neuraminidase__InfluenzaA__EPI498036
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucauccuggagcggaacaccgugcaccugaacagcaccaucaucgagcgcgagaucugccccaagguggccgacuacaagaacugguccaagccgcagugccagaucacgggguucgcccccuucagcaaggacaacuccauccggcucagcgccggcggggacaucugggucacccgcgagcccuacguguccugcagccuggacaagugcuaccaguucgcccugggccaggggaccacccucaagaacaagcacuccaacggcacgacccacgaccggacgccccaccgcacccugcugaugaacgagcucggcgugccguuccaccuggggaccaagcaggucugcaucgcguggagcuccagcuccugcuacgacggcaaggccuggcugcacaucugcgugaccggggacgacaagaacgccaccgccagcaucaucuacgacggcaugcucguggacuccaucgggagcugguccaagaacauccugcggacccaggagagcgagugcgucugcaucaacggcacgugcgcgguggugaugaccgacggcagcgccuccgggaaggccgacacccgcguccuguucauccgggagggcaagaucaucaacaucagcccccucuccgggagcgcccagcacguggaggagugcuccugcuacccccgcuaccccgaggugcggugcgucugccgcgacaacuggaagggcagcaaccggccgauccuguacaucaacauggccgacuacuccaucgagagcuccuacgugugcagcggccuggugggggacacgccccgcaacgacgacuccagcuccagcuccaacugccgggaccccaacaacgagcgcggcgcgcccggggucaagggcugggccuucgacgacgggaacgacguguggaugggccggaccaucaagaacggcagccgcuccggguacgagaccuuccggguggucaacggcuggaccauggccaacagcaagucccagaucaaccgccaggugaucguggacagcgacgacuggagcggguacuccggcaucuucagcgucgaggggaagaagugcaucaaccggugcuucuacguggagcucauccgcggccgcccgcaggagccccgggucugguggaccuccaacagcaucaucguguucugcggcacguccgggaccuacggcaccgggagcuggcccgacggcgccaacaucaacuucaugcccguguga

SEQ ID NO: 87402 - RNA, 1410 nt, Artificial Sequence
  derived and/or modified sequence opt1 from neuraminidase__InfluenzaA__EPI470902
augaaccccaaccagaagaucguggccaucggcagcgccucccugaccaucgcgaccaugugccuccugaugcagaucgcccuguucgccacgaccaugacccuccacuucaagcagaccgggugcacgaacagcuccgacaaccaggccgucccgugcggccccaucaucaucgagcgcaacaucaccgagaucgugcaccugaacagcaccacccuggagaaggagacgugccccaaguccgccggguaccggaacuggagcaagccccagugccagaucaccggcuucgcgccguucuccaaggacaacagcauccgccucgccgccgccggggacaucugggugacccgggagcccuacgucuccugcggccugggcaagugcuaccaguucgcgcuggggcagggcaccacgcucgacaacaagcacagcaacgggaccacccacgaccgcacgccccaccggacccugcugaugaacgagcucggcgugcccuuccaccuggccaccaagcaggucugcaucgccugguccagcuccagcugccacgacgggaaggccuggcugcacgugugcgugaccggcgacgacaagaacgccaccgcguccaucaucuacgacggcauccucguggacagcaucgccuccuggagcaagaacauccugcgcacgcaggaguccgagugcgucugcaucaacgggaccugcaccguggugaugaccgacggcagcgccagcgggcgggccgacacgcgcauccuguucauccgggagggcaagaucguccacaucuccccgcucagcggcuccgcccagcacguggaggagugcagcugcuacccccgcuaccccgaggugcggugcgucugccgcgacaacuggaagggguccaaccggcccgugcuguucaucaacauggcggacuacagcaucgacuccagcuacgugugcuccggccuggucggggacaccccgcgcaacgacgaccggagcuccagcuccaacugccgcgaccccaacaacgagcggggcgcccccggggugaagggcugggccuucgacagcggcaacgacaucuggauggggcgcaccaucgagaaggacucccggagcggcuacgagaccuuccgcgugaucgggggcugguccacggccaacagcaagucccagaucaaccggcaggucaucguggaccgcgacaacagcagcggguacuccggcaucuucagcguggagggcaaguccugcaucaaccgcugcuucuacgucgagcucauccgggggcgccccaaggagaaccgggugugguggaccagcaacuccaucaucgucuucugcggcaccagcgggaccuacggcacgggguccuggccggacggcgccaacaucaaccugaugcccaucuga

SEQ ID NO: 87403 - RNA, 1401 nt, Artificial Sequence
  derived and/or modified sequence opt1 from neuraminidase__InfluenzaA__EPI838241
augaaccccaaccagaagaucaccgccaucggcagcgugucccugaucaucgccaucaucugccuccugaugcagaucgcgauccugaccacgaccaugacccuccacuuccgccagaacgagugcagcaacuccagcaacaaccaggucaugccgugcgagcccaucaucaucgagcggaacaccgugcaccugaacuccacgaccaucgagcgcgagaucugccccaagguggccgaguacaagaacuggagcaagccccagugccagaucaccggguucgccccguucuccaaggacaacagcauccggcuguccgccagcggcgacaucugggucacccgcgagcccuacguguccugcagccucgacaagugcuaccaguucgcccuggggcagggcacgacccugaagaacaagcacuccaacgggaccgcgcacgaccggacgccccaccgcacccuccugaugaacgagcugggcgugcccuuccaccucggcaccaagcaggucugcaucgccuggagcuccagcuccugcuacgacgggaaggccuggcugcacgugugcgugaccggcgacgacaagaacgccaccgcgagcaucaucuacgacgggaugcuggucgacuccaucggcagcuggagcaagaacauccuccggacgcaggaguccgagugcgugugcaucaacgggaccugcgccguggucaugaccgacggcagcgccuccggcaaggccgacacccgcgugcuguucauccgggaggggaagaucaucaacaucagcccgcuguccggcagcgcccagcacguggaggagugcuccugcuacccccgcuaccccgagguccggugcgugugccgcgacaacuggaaggggagcaaccggcccauccucuacaucaacauggcggacuacuccaucgagagcuccuacgugugcagcggccuggucggcgacacgccgcgcaacgacgacuccagcuccagcuccaacugccgggaccccaacaacgagcgcggggcccccggcgugaaggggugggccuucgacgacggcaacgacguguggauggggcggaccaucaagaacggcagccgcuccggcuacgagaccuuccgggucgugaacggguggaccauggccaacagcaagagccagaucaaccgccaggugaucgucgaguccgacgacuggagcggcuacuccgggaucuucagcguggagggcaagaagugcaucaaccggugcuucuacgucgagcugauccgcgggcgcccccaggagccgcgggugugguggacguccaacagcaucaucguguucugcggcaccuccggcaccuacgggaccggcagcuggcccgacggggccaacaucaacuucaugcccaucuga

SEQ ID NO: 87404 - RNA, 1401 nt, Artificial Sequence; identical to SEQ ID NO: 87403
  derived and/or modified sequence opt1 from neuraminidase__InfluenzaA__EPI680525

SEQ ID NO: 87405 - RNA, 1401 nt, Artificial Sequence; identical to SEQ ID NO: 87011
  derived and/or modified sequence opt1 from neuraminidase__InfluenzaA__EPI690481

SEQ ID NO: 87406 - RNA, 1755 nt, Artificial Sequence
  derived and/or modified sequence opt1 from hemagglutinin__InfluenzaB__ABL76276
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugccccacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaagguggacgaccuccgggccgacaccaucuccagccagaucgagcuggcgguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgcgacaacguguccugcagcaucugccuguga

SEQ ID NO: 87407 - RNA, 1755 nt, Artificial Sequence
  derived and/or modified sequence opt1 from hemagglutinin__InfluenzaB__ABL76287
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccaucgaggugccccacaucugcaccaaggaggaggaccagaucaccgucuggggcuuccacuccgacaacaagauccagaugaagaaccuguacggggacagcaacccccagaaguucacguccagcgccaacggcgugaccacccacuacgugucccagaucgggggcuuccccgaccagaccgaggacggcgggcucccgcagagcggccggaucgucguggacuacauggugcagaagcccgggaagacgggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaagguggacgaccuccgggccgacacgaucuccagccagaucgagcuggcgguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugaucgccaucuucaucgucuacaugaucagccgcgacaacguguccugcagcaucugccuguga

SEQ ID NO: 87408 - RNA, 1755 nt, Artificial Sequence
  derived and/or modified sequence opt1 from hemagglutinin__InfluenzaB__ABL76298
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccguggaggucccccacaucugcaccaaggaggaggaccagaucaccguguggggcuuccacuccgacaacaagacgcagaugaagaaccuguacggggacagcaacccccagaaguucaccuccagcgccaacggcgugaccacccacuacgucucccagaucgggggcuuccccgaccagacggaggacggcgggcucccgcagagcggccggaucgugguggacuacaugguccagaagcccgggaagaccggcaccaucguguaccagcgcgggauccugcugccccagaagguguggugcgccuccggccggagcaaggucaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgucacgcugaugaucgccaucuucaucguguacauggugagccgcgacaacgucuccugcagcaucugccuguga

SEQ ID NO: 87409 - RNA, 1755 nt, Artificial Sequence
  derived and/or modified sequence opt1 from hemagglutinin__InfluenzaB__ABL76309
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccguggaggucccccacaucugcaccaaggaggaggaccagaucaccguguggggcuuccacuccgacaacaagacgcagaugaagaaccuguacggggacagcaacccccagaaguucaccuccagcgccaacggcgugaccacccacuacgucucccagaucgggggcuuccccgaccagacggaggacggcgggcucccgcagagcggccggaucgugguggacuacaugguccagcgccccgggaagaccggcaccaucguguaccagcgggggauccugcugccccagaagguguggugcgccuccggccgcagcaaggucaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccgaggaguucagccugcccacguucgacucccugaacaucaccgccgccagccucaacgacgacggccuggacaaccacaccauccugcuguacuacuccaccgccgcgagcucccucgccgucacgcugaugaucgccaucuucaucguguacaugaucagccgggacaacguguccugcagcaucugccuguga

SEQ ID NO: 87410 - RNA, 1755 nt, Artificial Sequence
  derived and/or modified sequence opt1 from hemagglutinin__InfluenzaB__ABL76331
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccaucgaggugccccacaucugcaccaaggaggaggaccagaucaccguguggggcuuccacuccgacaacaagacgcagaugaagaaccuguacggggacagcaacccccagaaguucaccuccagcgccaacggcgucaccacccacuacgugucccagaucgggggcuuccccgaccagacggaggacggcgggcucccgcagagcggccggaucguggucgacuacauggugcagaagcccgggaagaccggcaccaucguguaccagcgcgggauccugcugccccagaaggucuggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggucaagaaccugcagcgccugagcggggccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucguguacaugaucagccgcgacaacgucuccugcagcaucugccuguga

SEQ ID NO: 87411 - RNA, 1755 nt, Artificial Sequence
  derived and/or modified sequence opt1 from hemagglutinin__InfluenzaB__ABL76342
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccguggaggucccccacaucugcaccaaggaggaggaccagaucaccguguggggcuuccacuccgacaacaagacgcagaugaagaaccuguacggggacagcaacccccagaaguucaccuccagcgccaacggcgugaccacccacuacgucucccagaucggggacuuccccgaccagacggaggacggcggccucccgcagagcgggcggaucgugguggacuacaugguccagaagcccggcaagaccgggaccaucguguaccagcgcggcauccugcugccccagaagguguggugcgccuccgggcggagcaaggucauccgcggcagccucccccugaucggcgaggcggacugccugcacgagaaguacgggggccucaacaaguccaagccguacuacaccggggagcacgccaaggccaucggcaacugccccaucugggugaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccagccacggcgcccacggggucgccguggcggccgaccucaaguccacccaggaggccaucaacaagaucacgaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggcggugcugcucuccaacgaggggaucaucaacagcgaggacgagcaccuccuggcccuggagcggaagcugaagaagaugcugggccccuccgccguggacaucggcaacgggugcuucgagaccaagcacaagugcaaccagaccugccucgaccgcaucgccgcgggcaccuucaacgccggggacuucagccugcccacguucgacucccugaacaucaccgccgccagccucaacgacgacggccuggacaaccacaccauccugcuguacuacuccaccgccgcgagcucccucgccgucacgcugaugaucgccaucuucaucguguacaugaucagccgggacaacguguccugcagcaucugccuguga

SEQ ID NO: 87412 - RNA, 1755 nt, Artificial Sequence
  derived and/or modified sequence opt1 from hemagglutinin__InfluenzaB__ABL76353
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccguggaggucccccacaucugcaccaaggaggaggaccagaucaccguguggggcuuccacuccgacaacaagacgcagaugaagaaccuguacggggacagcaacccccagaaguucaccuccagcgccaacggcgugaccacccacuacgucucccagaucgggggcuuccccgaccagacggaggacggcgggcucccgcagagcggccggaucgugguggacuacaugguccagaagcccgggaagaccggcaccaucguguaccagcgcgggauccugcugccccagaagguguggugcgccuccggccggagcaaggucauccgcggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgacuucagccugcccacguucgacucccugaacaucaccgccgccagccucaacgacgacgggcuggacaaccacaccauccugcuguacuacuccaccgccgcgagcucccucgccgucacgcugaugaucgccaucuucaucguguacaugaucagccgggacaacguguccugcagcaucugccuguga

SEQ ID NO: 87413 - RNA, 1755 nt, Artificial Sequence
  derived and/or modified sequence opt1 from hemagglutinin__InfluenzaB__ABL76375
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 87414 - RNA, 1755 nt, Artificial Sequence; identical to SEQ ID NO: 87413
  derived and/or modified sequence opt1 from hemagglutinin__InfluenzaB__ABL76386

SEQ ID NO: 87415 - RNA, 1755 nt, Artificial Sequence
  derived and/or modified sequence opt1 from hemagglutinin__InfluenzaB__ABL76408
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugcuucaacugcaccgaccuggacgucgcccuggggcgccccaugugcgugggcaucacgcccuccgccaaggcgagcauccuccacgaggugcggcccgucaccuccggcugcuuccccaucaugcacgaccgcaccaagauccggcagcugcccaaccugcuccgcggguacgagaagauccggcugagcacccagaacgugaucgacgccgagaaggccccgggcgggcccuaccgccugggcacguccgggagcugccccaacgccaccuccaagagcggcuucuucgcgaccauggccugggccgugccccggggcaacaacaagaccgccacgaacccgcucaccgucgaggugccccacaucugcaccaaggaggaggaccagaucaccguguggggguuccacuccgacaacaagacgcagaugaagaaccuguacggcgacagcaacccccagaaguucaccuccagcgccaacgggaucaccacccacuacgucucccagaucggcggcuuccccgaccagacggaggacgggggccugccgcagagcgggcgcaucgugguggacuacaugguccagaagcccggcaagaccgggaccaucguguaccagcggggcauccuccugccccagaagguguggugcgcguccggccgcagcaaggucaucaaggggagccugccccucaucggcgaggccgacugccugcacgagaaguacgggggccugaacaaguccaagccguacuacaccggggagcacgccaaggccaucggcaacugccccaucugggugaagacgccccucaagcuggccaacggcaccaaguaccggcccccggcgaagcugcucaaggagcgcggguucuucggcgccaucgccggguuccuggagggcgggugggagggcaugaucgccggcuggcacggguacaccagccacggcgcccacgggguggcggucgccgccgaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgcggacaccaucuccagccagaucgagcucgccgugcugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgcggccggcaccuucaacgccggggaguucagccuccccacguucgacucccugaacaucaccgccgccagccugaacgacgacggccucgacaaccacaccauccugcuguacuacuccaccgcggccagcucccuggccgucacgcucaugaucgccaucuucaucguguacaugaucagccgggacaacguguccugcagcaucugccuguga

SEQ ID NO: 87416 - RNA, 1755 nt, Artificial Sequence
  derived and/or modified sequence opt1 from hemagglutinin__InfluenzaB__ABL76419
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugcuucaacugcaccgaccuggacgucgcccuggggcgccccaugugcgugggcaucacgcccuccgccaaggcgagcauccuccacgagauccggcccgugaccuccggcugcuuccccaucaugcacgaccgcaccaagauccggcagcugcccaaccugcuccgcggguacgagaagauccggcugagcacccagaacgucaucgacgccgagaaggccccgggcgggcccuaccgccugggcacguccgggagcugccccaacgccaccuccaagagcggcuucuucgcgaccauggccugggccgugccccggggcaacaacaagaccgccacgaacccgcucaccguggaggucccccacaucugcaccaaggaggaggaccagaucaccguguggggguuccacuccgacaacaagacgcagaugaagaaccuguacggcgacagcaacccccagaaguucaccuccagcgccaacgggaucaccacccacuacgugucccagaucggcggcuuccccgaccagacggaggacgggggccugccgcagagcgggcgcaucgucguggacuacauggugcagaagcccggcaagaccgggaccaucgucuaccagcggggcauccuccugccccagaagguguggugcgcguccggccgcagcaaggugaucaaggggagccugccccucaucggcgaggccgacugccugcacgagaaguacgggggccugaacaaguccaagccguacuacaccggggagcacgccaaggccaucggcaacugccccaucugggucaagacgccccucaagcuggccaacggcaccaaguaccggcccccggcgaagcugcucaaggagcgcggguucuucggcgccaucgccggguuccuggagggcgggugggagggcaugaucgccggcuggcacggguacaccagccacggcgcccacgggguggcgguggccgccgaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgcggacaccaucuccagccagaucgagcucgccguccugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgcggccggcaccuucaacgccggggaguucagccuccccacguucgacucccugaacaucaccgccgccagccugaacgacgacggccucgacaaccacaccauccugcuguacuacuccaccgcggccagcucccuggccgugacgcucaugaucgccaucuucaucgucuacaugaucagccgggacaacguguccugcagcaucugccuguga

SEQ ID NO: 87417 - RNA, 1758 nt, Artificial Sequence
  derived and/or modified sequence opt1 from hemagglutinin__InfluenzaB__ABL76441
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagccgggcacgaucaccuaccagcggggcauccuccugccccagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacgagcucgacaaccacaccauccugcuguacuacuccaccgccgccagcucccuggcggugacccucaugaucgccaucuucguggucuacauggugagccgggacaacguguccugcagcaucugccuguga

SEQ ID NO: 87418 - RNA, 1758 nt, Artificial Sequence
  derived and/or modified sequence opt1 from hemagglutinin__InfluenzaB__ABL76463
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaaggugaacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87419 - RNA, 1758 nt, Artificial Sequence
  derived and/or modified sequence opt1 from hemagglutinin__InfluenzaB__ABL76474
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacgagcucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87420 - RNA, 1758 nt, Artificial Sequence
  derived and/or modified sequence opt1 from hemagglutinin__InfluenzaB__ABL76485
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgugaccauggccugggccgugcccaagaacgacaacaacaagaccgccaccaacucccucacgaucgaggucccguacaucugcaccgagggggaggaccagaucaccguguggggcuuccacagcgacaacgagacccagauggcgaagcuguacggggacuccaagccccagaaguucacgagcuccgccaacggcgugaccacccacuacgucagccagaucggcggguuccccaaccagaccgaggacggcgggcugccccaguccggccgcaucgugguggacuacaugguccagaaguccgggaagacgggcaccaucaccuaccagcggggcauccuccugccgcagaagguguggugcgccuccgggcgcagcaaggugaucaagggcagccugccccucaucggggaggccgacugccugcacgagaaguacggcgggcugaacaaguccaagcccuacuacaccggcgagcacgccaaggcgaucggcaacugccccaucugggucaagacgccgcucaagcuggccaacgggaccaaguaccggccgcccgccaagcugcucaaggagcgcggcuucuucggggccaucgccggcuuccuggagggcgggugggagggcaugaucgcgggguggcacggcuacaccagccacggggcccacggcguggccgucgccgccgaccugaaguccacccaggaggcgaucaacaagaucacgaagaaccucaacagccuguccgagcuggaggugaagaaccuccagcggcugagcggcgccauggacgagcugcacaacgagauccucgagcuggacgagaagguggacgaccugcgcgccgacaccaucuccagccagaucgagcucgccguccugcuguccaacgaggggaucaucaacagcgagaacgagcaccuccuggcccuggagcggaagcucaagaagaugcugggccccuccgcgguggagaucgggaacggcugcuucgagaccaagcacaagugcaaccagaccugccuggaccgcaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucgucguguacauggugagccgggacaacgucuccugcagcaucugccuguga

SEQ ID NO: 87421 - RNA, 1758 nt, Artificial Sequence
  derived and/or modified sequence opt1 from hemagglutinin__InfluenzaB__ABL76507
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 87422 - RNA, 1758 nt, Artificial Sequence
  derived and/or modified sequence opt1 from hemagglutinin__InfluenzaB__ABL76518
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 87423 - RNA, 1758 nt, Artificial Sequence
  derived and/or modified sequence opt1 from hemagglutinin__InfluenzaB__ABL76529
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgugaccauggccugggccgugcccaagaacgacaacaacaagaccgccaccaacucccucacgaucgaggucccguacaucugcaccgagggggaggaccagaucaccguguggggcuuccacagcgacaacgagacccagauggcgaagcuguacggggacuccaagccccagaaguucacgagcuccgccaacggcgugaccacccacuacgucagccagaucggcggguuccccaaccagaccgaggacggcgggcugccccaguccggccgcaucgugguggacuacaugguccagaaguccgggaagacgggcaccaucaccuaccagcggggcauccuccugccgcagaagguguggugcgccuccgggcgcagcaaggugaucaagggcagccugccccucaucggggaggccgacugccugcacgagaaguacggcgggcugaacaaguccaagcccuacuacaccggcgagcacgccaaggcgaucggcaacugccccaucugggucaagacgccgcucaagcuggccaacgggaccaaguaccggccgcccgccaagcugcucaaggagcgcggcuucuucggggccaucgccggcuuccuggagggcgggugggagggcaugaucgcgggguggcacggcuacaccagccacggggcccacggcguggccgucgccgccgaccugaaguccacccaggaggcgaucaacaagaucacgaagaaccucaacagccuguccgagcuggaggugaagaaccuccagcggcugagcggcgccauggacgagcugcacaacgagauccucgagcuggacgagaagguggacgaccugcgcgccgacaccaucuccagccagaucgagcucgccguccugcuguccaacgaggggaucaucaacagcgaggacgagcaccuccuggcccuggagcggaagcucaagaagaugcugggccccuccgcgguggagaucgggaacggcugcuucgagaccaagcacaagugcaaccagaccugccuggaccgcaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucgucguguacauggugagccgggacaacgucuccugcagcaucugccuguga

SEQ ID NO: 87424 - RNA, 1758 nt, Artificial Sequence
  derived and/or modified sequence opt1 from hemagglutinin__InfluenzaB__ABL76540
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgaggucaagcccgugacguccggcugcuuccccaucaugcacgaccggaccaagauccgccagcugcccaaccuccugcggggguacgagcacauccgccugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87425 - RNA, 1758 nt, Artificial Sequence
  derived and/or modified sequence opt1 from hemagglutinin__InfluenzaB__ABL76551
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugauggccaucuucguggucuacauggugagccgggacaacguguccugcagcaucugccuguga

SEQ ID NO: 87426 - RNA, 1758 nt, Artificial Sequence
  derived and/or modified sequence opt1 from hemagglutinin__InfluenzaB__ABL76562
augaaggccaucaucgugcugcucauggucgugaccagcaacgccgaccgcaucugcacccggaucacguccagcaacagcccccacguggucaagaccgcgacccagggcgaggugaacgugaccggggucaucccgcugacgaccacccccaccaagagccacuucgccaaccugaagggcacgaagacccgcgggaagcucugccccaagugccugaacugcaccgaccuggacguggcccucggccggcccaagugcaccgggaacaucccguccgccgaggugagcauccugcacgagguccgccccgugacguccggcugcuuccccaucaugcacgaccggaccaagauccgccagcugcccaaccuccugcggggcuacgagcacauccgccugagcacccacaacgugaucaacgccgagaaggcgcccgggggccccuacaagaucgggaccuccggcagcugccccaacgucacgaacgggaacggcuucuucgccaccauggccugggccgugcccaagaacgacaacaacaagaccgcgaccaacucccucacgaucgaggugccguacaucugcaccgagggcgaggaccagaucaccgucuggggguuccacagcgacaacgagacccagauggccaagcuguacggcgacuccaagccccagaaguucacgagcuccgccaacggggugaccacccacuacgugagccagaucggcggcuuccccaaccagaccgaggacgggggccugccccaguccgggcggaucgucguggacuacauggugcagaaguccggcaagacggggaccaucaccuaccagcgcggcauccuccugccgcagaaggucuggugcgccuccggccggagcaaggugaucaaggggagccugccccucaucggcgaggccgacugccugcacgagaaguacgggggccugaacaaguccaagcccuacuacaccggggagcacgcgaaggccaucggcaacugccccaucugggugaagacgccgcucaagcuggccaacggcaccaaguaccgcccgcccgccaagcugcucaaggagcggggguucuucggcgccaucgcgggguuccuggagggcgggugggagggcaugaucgccggcuggcacggguacaccagccacggcgcccacggggucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcaccuucgacgugggggaguucagccucccgacguucgacucccugaacaucaccgcggccagccugaacgacgacggccucgacaaccacaccauccugcuguacuacuccaccgccgccagcucccuggccgugacgcucaugaucgcgaucuucgucguguacauggugagccgcgacaacgucuccugcagcaucugccuguga

SEQ ID NO: 87427 - RNA, 1758 nt, Artificial Sequence
  derived and/or modified sequence opt1 from hemagglutinin__InfluenzaB__ABL76573
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87428 - RNA, 1758 nt, Artificial Sequence; identical to SEQ ID NO: 87427
  derived and/or modified sequence opt1 from hemagglutinin__InfluenzaB__ABL76584

SEQ ID NO: 87429 - RNA, 1758 nt, Artificial Sequence; identical to SEQ ID NO: 87427
  derived and/or modified sequence opt1 from hemagglutinin__InfluenzaB__ABL76595

SEQ ID NO: 87430 - RNA, 1758 nt, Artificial Sequence; identical to SEQ ID NO: 87427
  derived and/or modified sequence opt1 from hemagglutinin__InfluenzaB__ABL76606

SEQ ID NO: 87431 - RNA, 1758 nt, Artificial Sequence
  derived and/or modified sequence opt1 from hemagglutinin__InfluenzaB__ABL76617
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87432 - RNA, 1755 nt, Artificial Sequence
  derived and/or modified sequence opt1 from hemagglutinin__InfluenzaB__ABL76628
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccgcacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87433 - RNA, 1755 nt, Artificial Sequence
  derived and/or modified sequence opt1 from hemagglutinin__InfluenzaB__ABL76639
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaaggcggggacgaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagacgaagcacaagugcaaccagaccugccucgaccgcaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgggacaacguguccugcagcaucugccucuga

SEQ ID NO: 87434 - RNA, 1755 nt, Artificial Sequence
  derived and/or modified sequence opt1 from hemagglutinin__InfluenzaB__ABL76683
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87435 - RNA, 1752 nt, Artificial Sequence
  derived and/or modified sequence opt1 from hemagglutinin__InfluenzaB__ABL76694
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagcgcgccccgggcgggcccuaccggcucggcacguccgggagcugccccaacgucaccucccgcgacggcuucuucgccaccauggccugggcggugccccgggacaacaagaccgccacgaacccgcugaccguggagguccccuacaucugcaccaagggcgaggaccagaucaccguguggggguuccacagcgacaacaagacgcagaugaagaaccuguacggcgacuccaacccccagaaguucaccagcuccgccaacggggugaccacccacuacgucagccagaucggcggcuuccccaaccagacggaggacgggggccucccgcaguccgggcgcaucgugguggacuacaugguccagaagcccggcaagaccgggaccaucguguaccagcggggcgugcugcugccccagaaggucuggugcgccagcggccgcuccaaggugaucaaggggagccucccccugaucggcgaggccgacugccugcacgagaaguacgggggccucaacaagagcaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacgggguggccguggccgcggaccucaagagcacccaggaggccaucaacaagaucacgaagaaccugaacucccugagcgagcucgaggucaagaaccugcagcggcuguccggcgccauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcgcuggagcggaagcugaagaagaugcuggggcccagcgccgucgacaucggcaacgggugcuucgagaccaagcacaagugcaaccagaccugccucgaccgcaucgccgccggcaccuucaacgcgggggaguucucccugcccacguucgacagccugaacaucaccgccgccucccucaacgacgacggccuggacaaccacaccauccugcuguacuacagcaccgccgccuccagccucgcggugacgcugaugaucgccaucuucaucguguacauggucucccgggacaacgugagcugcuccaucugccuguga

SEQ ID NO: 87436 - RNA, 1758 nt, Artificial Sequence
  derived and/or modified sequence opt1 from hemagglutinin__InfluenzaB__ABL76716
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggucaacgggaccaaguaccgcccgcccgccaagcugcucaaggagcggggcuucuucggggccaucgccggcuuccuggagggcgggugggagggcaugaucgcgggguggcacggcuacaccagccacggggcccacggcguggccgucgccgccgaccugaaguccacccaggaggcgaucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcccuggagcgcaagcucaagaagaugcugggccccuccgcgguggagaucgggaacggcugcuucgagaccaagcacaagugcaaccagaccugccuggaccggaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucgucguguacauggugagccgcgacaacgucuccugcagcaucugccuguga

SEQ ID NO: 87437 - RNA, 1755 nt, Artificial Sequence
  derived and/or modified sequence opt1 from hemagglutinin__InfluenzaB__ABL76760
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccaucgaggugccccacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaagguggacgaccuccgggccgacaccaucuccagccagaucgagcuggcgguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucgacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgcgacaacguguccugcagcaucugccuguga

SEQ ID NO: 87438 - RNA, 1755 nt, Artificial Sequence
  derived and/or modified sequence opt1 from hemagglutinin__InfluenzaB__ABL76771
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccaucgaggugccccacaucugcaccaaggaggaggaccagaucaccgucuggggcuuccacuccgacgacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaagguggacgaccuccgggccgacaccaucuccagccagaucgagcuggcgguccugcucuccaacgagggcaucaucaacagcgaggacgagcaccuccuggcccuggagcgcaagcugaagaagauccugggccccuccgccguggacaucgggaacggcugcuucgagaccaagcacaagugcaaccagaccugccucgaccggaucgccgcggggaccuucgacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgcgacaacguguccugcagcaucugccuguga

SEQ ID NO: 87439 - RNA, 1755 nt, Artificial Sequence
  derived and/or modified sequence opt1 from hemagglutinin__InfluenzaB__ABL76782
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggucccccaugugcgugggcaucacgcccagcgccaaggccuccauccugcacgagguccgccccgugaccagcggcugcuuccccaucaugcacgaccggaccaagauccgccagcugcccaaccuccugcggggguacgagaagauccgccuguccacccagaacgugaucaacaucgagaaggcgccgggcgggcccuaccggcucggcacgagcggguccugccccaacgccaccagccgcuccggcuucuucgccaccauggccugggcggucccccgggacaacaacaagaccgccacgaacccgcugaccguggaggugccccacaucugcaccaaggaggaggaccagaucaccgucuggggcuuccacagcgacaacaaggcccagaugaagaaccuguacggggacuccaacccccagaaguucacgagcuccgccaacggcgugaccacccacuacgugagccagaucgggggcuuccccgaccagaccgaggacggcgggcucccgcaguccggccgcaucgucguggacuacauggugcagaagcccgggaagacgggcaccaucgucuaccagcgggggauccugcugccccagaagguguggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugaucgccaucuucaucgucuacaugaucucccgggacaacgugagcugcagcaucugccuguga

SEQ ID NO: 87440 - RNA, 1755 nt, Artificial Sequence; identical to SEQ ID NO: 87413
  derived and/or modified sequence opt1 from hemagglutinin__InfluenzaB__ABL76793

SEQ ID NO: 87441 - RNA, 1755 nt, Artificial Sequence; identical to SEQ ID NO: 87413
  derived and/or modified sequence opt1 from hemagglutinin__InfluenzaB__ABL76815

SEQ ID NO: 87442 - RNA, 1758 nt, Artificial Sequence
  derived and/or modified sequence opt1 from hemagglutinin__InfluenzaB__ABL76826
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccgagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87443 - RNA, 1758 nt, Artificial Sequence
  derived and/or modified sequence opt1 from hemagglutinin__InfluenzaB__ABL76837
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaaggugcggcagcugcccaaccuccugcgcggguacgagcacauccggcugagcacccacaacgucaucaacgccgagaaggcgccgggcgggcccuacaagaucggcaccuccgggagcugccccaacgugacgaacggcaacggcuucuucgccaccauggccugggccgugcccaagaacgacaacaacaagaccgcgaccaacucccucacggucgaggugccguacaucugcaccgagggggaggaccagaucaccguguggggcuuccacagcgacuccgagacccagauggccaagcuguacggggacagcaagccccagaaguucacguccagcuccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccagcgggcgcuccaaggucaucaagggcagccugccccucaucggggaggccgacugccugcacgagcgguacggcgggcugaacaaguccaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacccaggaggcgaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcccuggagcgcaagcucaagaagaugcugggccccuccgcgguggagaucgggaacggcugcuucgagaccaagcacaagugcaaccagaccugccuggaccggaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgucacgcucaugaucgcgaucuucgugguguacauggucagccgcgacaacgugagcugcuccaucugccuguga

SEQ ID NO: 87444 - RNA, 1755 nt, Artificial Sequence
  derived and/or modified sequence opt1 from hemagglutinin__InfluenzaB__ABL76848
augaaggccaucaucgugcugcucauggucgugaccagcaacgccgaccgcaucugcaccggcaucacguccagcaacuccagccacguggucaagaccgcgacccagggggaggugaacgugaccggcgccaucccccugacgaccaccccgaccaagucccacuucgccaaccugaaggggacgaagacccggggcaagcucugcccgaccugccugaacugcaccgaccuggacgucgcccucgggcgccccaugugcgugggcaucacgccgcccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggcccccggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 87445 - RNA, 1755 nt, Artificial Sequence; identical to SEQ ID NO: 87413
  derived and/or modified sequence opt1 from hemagglutinin__InfluenzaB__ABL76859

SEQ ID NO: 87446 - RNA, 1755 nt, Artificial Sequence
  derived and/or modified sequence opt1 from hemagglutinin__InfluenzaB__ABL76881
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccuccggcgggccguaccggcucggcacgagcggguccugccccaacgccaccagcaaguccggcuucuucgccaccauggcgugggccguccccaaggacaacaacaagaacgccaccaacccccugacgguggaggugccguacaucugcaccgagggcgaggaccagaucaccgucuggggguuccacagcgacaacgagacccagaugaagaaccuguacggcgacuccaacccccagaaguucacgagcuccgccaacggggugaccacccacuacgugagccagaucggcggcuuccccgaccagaaggaggacgggggccucccccaguccgggcgcaucgucguggacuacauggugcagaagccgggcaagaccgggacgaucgucuaccagcggggcgugcugcugccccagaagguguggugcgccagcggccgcagcaaggucaucaaggggucccucccccugaucggcgaggcggacugccugcacgagaaguacgggggccucaacaagagcaagcccuacuacaccggggagcacgccaaggccaucggcaacugcccgaucugggugaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccucccacggcgcccacggggucgccguggcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaaggucgacgaccuccgcgccgacaccaucagcucccagaucgagcuggcggugcugcucagcaacgagggcaucaucaacuccgaggacgagcaccuccuggcccuggagcggaagcugaagaagaugcuggggcccagcgccguggacaucggcaacgggugcuucgagacgaagcacaagugcaaccagaccugccucgaccgcaucgccgcgggcaccuucaacgccggggaguucucccugcccaccuucgacagccugaacaucaccgccgccucccucaacgacgacggccuggacaaccacacgauccugcuguacuacagcaccgccgcguccagccucgccgucacccugaugcuggccaucuucaucguguacauggugucccgggacaacgucagcugcagcaucugccucuga

SEQ ID NO: 87447 - RNA, 1755 nt, Artificial Sequence
  derived and/or modified sequence opt1 from hemagglutinin__InfluenzaB__ABL76892
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgaccagaccgaggacgggggccucccgcagagcgggcgcaucgugguggacuacaugguccagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgggacaacguguccugcagcaucugccucuga

SEQ ID NO: 87448 - RNA, 1755 nt, Artificial Sequence
  derived and/or modified sequence opt1 from hemagglutinin__InfluenzaB__ABL76903
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccaguccgugaucgacgcggagaaggccccgggcgggcccuaccggcucggcacgagcggguccugccccaacgccaccagcaaguccggcuucuucgccaccauggcgugggccguccccaaggacaacaacaagaacgccaccaacccgcugacgguggaggugcccuacaucugcaccgagggcgaggaccagaucaccgucuggggguuccacagcgacgacaagacccagaugaagaaccuguacggcgacuccaacccccagaaguucacgagcuccgccaacggggugaccacccacuacgugagccagaucggcggcuuccccgaccagaccgaggacgggggccucccgcaguccgggcgcaucgucguggacuacaugauccagaagcccggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcgcgcagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87449 - RNA, 1758 nt, Artificial Sequence
  derived and/or modified sequence opt1 from hemagglutinin__InfluenzaB__ABL76914
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccagcaacggcgugacgacccacuacgugucccagaucggcggguuccccaaccagaccgaggacggcgggcugccccagagcggccgcaucgucguggacuacauggugcagaaguccgggaagaccggcacgaucaccuaccagcggggcauccuccugccgcagaaggucuggugcgccagcgggcgcagcaaggugaucaagggcucccugccccucaucggggaggccgacugccugcacgagcgguacggcgggcugaacaagagcaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcagcaucugccuguga

SEQ ID NO: 87450 - RNA, 1755 nt, Artificial Sequence
  derived and/or modified sequence opt1 from hemagglutinin__InfluenzaB__ABL76936
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcacgacccccuccgccaaggccagcauccugcacgagguccggcccgugaccuccggcugcuuccccaucaugcacgaccgcaccaagauccggcagcugcccaaccuccugcgcggguacgagaagauccggcugagcacgcagaacgugaucaacgcggagaaggccccgggcgggcccuaccgccucggcaccuccgggagcugccccaacgccaccucccggagcggcuucuucgccaccauggcgugggccgucccccgcgacaacaacaagacggccaccaacccgcugaccguggaggugcccuacaucugcaccaaggaggaggaccagaucacggucuggggcuuccacuccgacgacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccggaucgucguggacuacauggugcagaagcccgggaagaccggcaccaucgucuaccagcgcggggugcugcugccccagaagguguggugcgccuccggccggagcaaggucaucaagggcagccucccccugaucggggaggcggacugccugcacgagaaguacggcgggcucaacaaguccaagccguacuacacgggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgucacccugaugaucgccaucuucaucguguacauggugagccgcgacaacgucuccugcagcaucugccuguga

SEQ ID NO: 87451 - RNA, 1755 nt, Artificial Sequence
  derived and/or modified sequence opt1 from hemagglutinin__InfluenzaB__ABL76947
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccucccggagcggcuucuucgcgaccauggccugggccgugccccgcgacaacaacaagaccgccacgaacccgcugaccgucgaggugccccacaucugcaccaaggaggaggaccagaucaccguguggggcuuccacuccgacgacaagacgcagaugaagaaccuguacggggacagcaacccccagaaguucaccuccagcaccaacggcaucaccacgcacuacgucucccagaucgggggcuuccccgaccagaccgaggacggcgggcucccgcagagcggccggaucgugguggacuacaugguccagaagcccgggaagaccggcaccaucguguaccagcgcgggauccugcugccccagaagguguggugcgccuccggccggagcaaggucaucaagggcagccucccccugaucggggaggcggacugccugcacgagaaguacggcgggcucaacaaguccaagccguacuacacgggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgucacccugaugaucgccaucuucaucguguacaugaucagccgcgacaacguguccugcagcaucugccuguga

SEQ ID NO: 87452 - RNA, 1758 nt, Artificial Sequence
  derived and/or modified sequence opt1 from hemagglutinin__InfluenzaB__ABL76958
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgggacaacaucuccugcagcaucugccuguga

SEQ ID NO: 87453 - RNA, 1758 nt, Artificial Sequence
  derived and/or modified sequence opt1 from hemagglutinin__InfluenzaB__ABL76969
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgcggacccgcggcaagcucugccccaagugccugaacugcaccgaccuggacguggcccucgggcggcccaagugcaccggcaacaucccguccgccaaggugagcauccugcacgagguccgccccgugacguccggcugcuuccccaucaugcacgaccggaccaagauccgccagcugcccaaccuccugcggggguacgagcacauccgccugagcauccacaacgugaucaacgccgagaaggcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccgucuggggcuuccacagcgacaacgaggcccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucgacgccggcgaguucagccuccccaccuucgacucccugaacaucaccgccgccagccugaacgacgacggccucgacaaccacacgauccugcuguacuacuccaccgccgcgagcucccuggccgugacccucaugaucgccaucuucguggucuacauggugagccgcgacaacguguccugcagcaucugccuguga

SEQ ID NO: 87454 - RNA, 1755 nt, Artificial Sequence
  derived and/or modified sequence opt1 from hemagglutinin__InfluenzaB__ABL76980
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccuccaagagcggcuucuucgccaccauggcgugggccgucccccgggacaacaacaagaccgccacgaacccgcugaccguggaggugcccuacaucugcaccaaggaggaggaccagaucaccgucuggggcuuccacuccgacaacaagacgcagaugaagaaccuguacggggacagcgacccccagaaguucaccuccagcgccaacggcgugaccacccacuacgugucccagaucgggggcuuccccgaccagacggaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgggacaacguguccugcagcaucugccuguga

SEQ ID NO: 87455 - RNA, 1752 nt, Artificial Sequence
  derived and/or modified sequence opt1 from hemagglutinin__InfluenzaB__ABL76991
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaucaccccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacaacaagauccagaugaagaaccuguacggcgacagcaacccccagaaguucaccuccagcgccaacgggaucacgacccacuacgugucccagaucggcggcuuccccaaccagaccgaggacgggggccucccgcagagcgggcgcaucguggucgacuacauggugcagaagcccggcaagaccgggacgaucguguaccagcggggcguccugcugccccagaagguguggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagaagggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcgcuggagcgcaagcugaagaagaugcuggggcccuccgccguggacaucggcaacgggugcuucgagacgaagcacaagugcaaccagaccugccucgaccggaucgccgccggcaccuucaacgcgggggaguucagccugcccaccuucgacucccugaacaucaccgccgccagccucaacgacgacggccuggacaaccacacgauccugcuguacuacuccaccgccgccagcucccucgcggugacccugaugaucgccaucuucaucgucuacauggugagccgcgacaacguguccugcagcaucugccuguga

SEQ ID NO: 87456 - RNA, 1755 nt, Artificial Sequence
  derived and/or modified sequence opt1 from hemagglutinin__InfluenzaB__ABL77002
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccaucgaggugccccacaucugcaccaaggaggaggaccagaucaccaucuggggcuuccacuccgacgacaagacgcagaugaagaaccuguacggggacagcaacccccagaaguucaccuccagcgccaacggcgucaccacccacuacgugucccagaucgggggcuuccccgaccagacggaggacggcgggcucccgcagagcggccggaucguggucgacuacauggugcagaagcccgggaagaccggcaccaucguguaccagcgcgggauccugcugccccagaaggucuggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggucaagaaccugcagcgccugagcggggccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgccgcggggaccuucgacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucguguacaugaucagccgcgacaacgucuccugcagcaucugccuguga

SEQ ID NO: 87457 - RNA, 1755 nt, Artificial Sequence
  derived and/or modified sequence opt1 from hemagglutinin__InfluenzaB__ABL77013
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccuccaagagcggcuucuucgccaccauggcgugggccgucccccgggacaacaacaagaccgccacgaacccgcugaccguggaggugcccuacaucugcaccaaggaggaggaccagaucaccgucuggggcuuccacuccgacaacaagaaccagaugaagaaccuguacggggacagcgacccccagaaguucacguccagcgccaacggcgugaccacccacuacgugucccagaucgggggcuuccccgaccagaccgaggacggcgggcucccgcagagcggccgcaucgucguggacuacauggugcagaagcccgggaagacgggcaccaucgucuaccagcgggggauccugcugccccagaagguguggugcgccuccggccgcagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugaucgccaucuucaucgucuacaugaucagccgggacaacguguccugcagcaucugccuguga

SEQ ID NO: 87458 - RNA, 1755 nt, Artificial Sequence
  derived and/or modified sequence opt1 from hemagglutinin__InfluenzaB__ABL77024
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacgacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 87459 - RNA, 1755 nt, Artificial Sequence
  derived and/or modified sequence opt1 from hemagglutinin__InfluenzaB__ABL77035
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccucccggagcggcuucuucgcgaccauggccugggccgugccccgcgacaacaacaagaccgccacgaacccgcugaccgucgaggugccccacaucugcaccaaggaggaggaccagaucaccguguggggcuuccacuccgacgacaagacgcagaugaagaaccuguacggggacagcaacccccagaaguucaccuccagcgccaacggcgucaccacccacuacgugucccagaucgggggcuuccccgaccagacggaggacggcgggcucccgcagagcggccggaucguggucgacuacauggugcagaagcccgggaagaccggcaccaucguguaccagcgcgggauccugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcgucgcgguggccgccgaccucaaguccacccaggaggccaucaacaagaucacgaagaaccugaacagccuguccgagcucgaggucaagaaccugcagcgccugagcggggccauggacgagcuccacaacgagauccuggagcuggacgagaagguggacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgugacgcugaugaucgccaucuucaucguguacaugaucagccgcgacaacgucuccugcagcaucugccuguga

SEQ ID NO: 87460 - RNA, 1755 nt, Artificial Sequence
  derived and/or modified sequence opt1 from hemagglutinin__InfluenzaB__ABL77046
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacgacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccaucgacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgugacgcugaugaucgccaucuucaucgucuacaugaucagccgggacaacguguccugcagcaucugccuguga

SEQ ID NO: 87461 - RNA, 1755 nt, Artificial Sequence
  derived and/or modified sequence opt1 from hemagglutinin__InfluenzaB__ABL77057
augaaggccaucaucgugcugcucauggucgugaccagcaaggccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugaagcccgucaccuccggcugcuuccccaucaugcacgaccggaccaagauccgccagcugcccaaccuccugcggggguacgagaagauccgccugagcacccagaacgugaucaacgccgagaaggccccgggcgggcccuaccggcucggcacguccgggagcugccccaacgccaccuccaagagcggcuucuucgcgaccauggccugggccgugccccgcgacaacaacaagaccgccacgaacccgcugaccgucgaggugccccacaucugcaccaaggaggaggaccagaucaccguguggggcuuccacuccgacaacaagccccagaugaagaaccuguacggggacagcaacccccagaaguucacguccagcgccaacggcaucaccacccacuacgucucccagaucgggggcuucccggagcagaccgaggacggcgggcucccccagagcggccggaucgugguggacuacaugguccagaagcccgggaagacgggcaccaucguguaccagcgcgggauccugcugccccagaagguguggugcgcguccggccggagcaaggucaucaagggcagccucccgcugaucggggaggccgacugccugcacgagaaguacggcgggcucaacaaguccaagcccuacuacaccggcgagcacgccaaggccaucgggaacugccccaucugggugaagacgccccugaagcuggccaacggcaccaaguaccgcccgcccgcgaagcuccugaaggagcggggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugaucgccaucuucaucguguacaugaucagccgcgacaacguguccugcagcaucugccuguga

SEQ ID NO: 87462 - RNA, 1758 nt, Artificial Sequence
  derived and/or modified sequence opt1 from hemagglutinin__InfluenzaB__ABL77068
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgagaaccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacacgagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuucaacgcgggcgaguucagccuccccaccuucgacucccugaacaucaccgccgccagccugaacgacgacggccucgacaaccacacgauccugcuguacuacuccaccgccgccagcucccuggcggugacccucaugaucgccaucuucguggucuacauggugagccgcgacaacguguccugcagcaucugccuguga

SEQ ID NO: 87463 - RNA, 1758 nt, Artificial Sequence
  derived and/or modified sequence opt1 from hemagglutinin__InfluenzaB__ABL77090
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccugaccaagagccacuucgccaaccucaaggggacgaagacccggggcaagcugugccccaagugccugaacugcaccgaccucgacguggcccuggggcgccccaagugcaccggcaacauccccuccgccaaggugagcauccugcacgagguccggccggugacguccggcugcuuccccaucaugcacgaccgcaccaagauccggcagcuccccaaccugcugcgcggguacgagcggauccgccucagcaaccacaacgugaucaacgccgagaaggcgcccggcgggccguacaagaucggcaccuccgggagcugccccaacgucaccaacggcaacggcuucuucgccacgauggccugggccgugcccaagaacgagaacaacaagaccgcgaccaacucccugaccaucgaggugcccuacaucugcacggagggggaggaccagaucaccgucuggggcuuccacagcgacaacgagauccagauggugaagcuguacggggacuccaagccgcagaaguucaccagcuccgccaacggcgugaccacgcacuacgucagccagaucggcggguuccccaaccagaucgaggacggcgggcucccccaguccggccggaucgugguggacuacaugguccagaaguccgggaagaccggcaccaucaccuaccagcgcggcauccugcugccccagaagguguggugcgccuccgggcggagcaagaucaucaagggcagccucccgcugaucggggaggccgacugccugcacgagaaguacggcgggcucaacaaguccaagcccuacuacacgggcgagcacgccaaggcgaucggcaacugccccaucugggugaagacgccccugaagcuggccaacgggaccaaguaccgcccgcccgccaagcuccugaaggagcggggcuucuucggggccaucgccggcuuccuggagggcgggugggagggcaugaucgcgggguggcacggcuacaccagccacggggcccacggcgucgccguggccgccgaccucaaguccacccaggaggcgaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggccgugcugcucuccaacgaggggaucaucaacagcgaggacgagcaccuccuggcccuggagcgcaagcugaagaagaugcugggccccuccgcggucgagaucgggaacggcugcuucgagaccaagcacaagugcaaccagacgugccucgaccggaucgccgccgggaccuucaacgccggcgaguucagccugcccaccuucgacucccugaacaucaccgcggccagccucaacgacgacggccuggacaaccacaccauccugcuguacuacuccacggccgccagcucccucgccgugacccugaugaucgcgaucuucguggucuacauggugagccgcgacaacguguccugcagcaucugccuguga

SEQ ID NO: 87464 - RNA, 1755 nt, Artificial Sequence
  derived and/or modified sequence opt1 from hemagglutinin__InfluenzaB__ABL77101
augaaggccaucaucgugcugcucauggucgugaccagcaaggccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugaagcccgucaccuccggcugcuuccccaucaugcacgaccggaccaagauccgccagcugcccaaccuccugcggggguacgagaagauccgccugagcacccagaacgugaucaacgccgagaaggccccgggcgggcccuaccggcucggcacguccgggagcugccccaacgccaccuccaagagcggcuucuucgcgaccauggccugggccgugccccgcgacaacaacaagaccgccacgaacccgcugaccgucgaggugccccacaucugcaccaaggaggaggaccagaucaccguguggggcuuccacuccgacgacaagacgcagaugaagaaccuguacggggacagcaacccccagaaguucaccuccagcgccaacggcaucaccacccacuacgucucccagaucgggggcuuccccgagcagacggaggacggcgggcucccgcagagcggccggaucgugguggacuacaugguccagaagcccgggaagaccggcaccaucguguaccagcgcgggauccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcgccugagcggggccauggacgagcuccacaacgagauccuggagcuggacgagaaggucgacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgcgacaacguguccugcagcaucugccuguga

SEQ ID NO: 87465 - RNA, 1758 nt, Artificial Sequence
  derived and/or modified sequence opt1 from hemagglutinin__InfluenzaB__ABL77134
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgaggcccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucaacgccggcgaguucagccuccccaccuucgacucccugaacaucaccgccgccagccugaacgacgacggccucgacaaccacacgauccugcuguacuacgccaccgcggccuccagccuggccgugacccucaugaucgccaucuucguggucuacauggugucccgcgacaacgugagcugcuccaucugccuguga

SEQ ID NO: 87466 - RNA, 1758 nt, Artificial Sequence
  derived and/or modified sequence opt1 from hemagglutinin__InfluenzaB__ABL77145
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgaggaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacuccgagacccagauggccaagcuguacggggacagcaagccccagaaguucaccuccagcgccaacggcgugacgacccacuacgugucccagaucggcggguuccccaaccagaccgaggacggcgggcugccccagagcggccggaucgucguggacuacauggugcagaaguccgggaagaccggcacgaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucaacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcagcaucugccuguga

SEQ ID NO: 87467 - RNA, 1755 nt, Artificial Sequence
  derived and/or modified sequence opt1 from hemagglutinin__InfluenzaB__ABL77156
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacgacaagacccagaugaagaaccuguacggcgacagcaacccccagaaguucacguccagcgccaacggggugaccacccacuacgucucccagaucggcggcuuccccgaccagaccgaggacgggggccucccgcagagcgggcgcaucgugguggacuacaugguccagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgggacaacguguccugcagcaucugccucuga

SEQ ID NO: 87468 - RNA, 1758 nt, Artificial Sequence
  derived and/or modified sequence opt1 from hemagglutinin__InfluenzaB__ABL77178
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacuccgagacccagauggccaagcuguacggggacagcaagccccagaaguucaccuccagcgccaacggcgugacgacccacuacgugucccagaucggcggguuccccaaccagaccgaggacggcgggcugccccagagcggccggaucgucguggacuacauggugcagaaguccgggaagaccggcacgaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucaacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcagcaucugccuguga

SEQ ID NO: 87469 - RNA, 1755 nt, Artificial Sequence
  derived and/or modified sequence opt1 from hemagglutinin__InfluenzaB__ABL77189
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggauccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagauccagaugaagaaccuguacggcgacagcaacccccagaaguucaccuccagcgccaacggggugacgacccacuacgucucccagaucggcggcuuccccgaccagaccgaggacgggggccucccgcagagcgggcggaucgugguggacuacaugguccagaagcccggcaagaccgggacgaucguguaccagcgcggcgugcugcugccccagaaggucuggugcgccuccggccggagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagacgaagcacaagugcaaccagaccugccucgaccggaucgccgcgggcaccuucaacgccggggaguucagccugcccaccuucgacucccugaacaucaccgccgccagccucaacgacgacggccuggacaaccacacgauccugcuguacuacuccaccgccgcgagcucccucgccgugacccugaugcuggccaucuucaucguguacauggucagccgcgacaacguguccugcagcaucugccucuga

SEQ ID NO: 87470 - RNA, 1758 nt, Artificial Sequence
  derived and/or modified sequence opt1 from hemagglutinin__InfluenzaB__ABL77200
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaugggcaacaucccguccgccaaggugagcauccugcacgagguccggcccgugaccuccggcugcuuccccaucaugcacgaccgcacgaagauccggcagcugcccaaccuccugcgcggguacgagcacauccggcugagcacccacaacgugaucaacgccgagaaggcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaaggccggcaccaucacguaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccggccgcccgccaagcugcucaaggagcgcggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgggaagguggacgaccugcgcgccgacaccaucuccagccagaucgagcucgcggugcugcuguccaacgagggcaucaucaacagcgaggacgagcaccuccuggcccuggagcggaagcucaagaagaugcuggggcccuccgccgucgagaucggcaacgggugcuucgagacgaagcacaagugcaaccagaccugccuggaccgcaucgccgcgggcaccuucgacgccggcgaguucagccuccccaccuucgacucccugaacaucaccgccgccagccugaacgacgacgggcucgacaaccacacgauccugcuguacuacuccaccgccgcgagcucccuggccgugacccucaugaucgccaucuucguggucuacauggugagccgggacaacguguccugcagcaucugccuguga

SEQ ID NO: 87471 - RNA, 1755 nt, Artificial Sequence
  derived and/or modified sequence opt1 from hemagglutinin__InfluenzaB__ABL77222
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacagcaagacccagaugaagaaccuguacggcgacuccaacccccagaaguucacgagcuccgccaacggggugaccacccacuacgugagccagaucggcggcuuccccgaccagaccgaggacgggggccucccccaguccgggcgcaucgucguggacuacaugaugcagaagccgggcaagacggggaccaucguguaccagcggggcguccugcugccccagaagguguggugcgcgagcggccgcagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacacgaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugucccgggacaacgugagcugcagcaucugccucuga

SEQ ID NO: 87472 - RNA, 1758 nt, Artificial Sequence
  derived and/or modified sequence opt1 from hemagglutinin__InfluenzaB__ABL77233
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgaggcccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaagucccggaagaccgggacgaucaccuaccagcgcggcauccuccugccgcagaagguguggugcgccuccggccggagcaaggucaucaaggggagccugccccucaucggcgaggcggacugccugcacgagaaguacgggggccugaacaaguccaagcccuacuacaccggggagcacgccaaggccaucggcaacugccccaucugggugaagaccccgcucaagcuggccaacggcacgaaguaccgcccgcccgccaagcugcucaaggagcggggguucuucggcgcgaucgccggguuccuggagggcgggugggagggcaugaucgccggcuggcacggguacaccagccacggcgcccacgggguggccgucgcggccgaccugaaguccacccaggaggccaucaacaagaucaccaagaaccucaacagccuguccgagcuggaggugaagaaccuccagcgccugagcggcgccauggacgagcugcacaacgagauccucgagcuggacgagaaggucgacgaccugcgggccgacacgaucuccagccagaucgagcucgcggugcugcuguccaacgagggcaucaucaacagcgaggacgagcaccuccuggcccuggagcgcaagcucaagaagaugcuggggcccuccgccguggagaucggcaacgggugcuucgagaccaagcacaagugcaaccagaccugccuggaccggaucgccgcgggcaccuucgacgccggggaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgcgacaacguguccugcagcaucugccuguga

SEQ ID NO: 87473 - RNA, 1758 nt, Artificial Sequence
  derived and/or modified sequence opt1 from hemagglutinin__InfluenzaB__ABL77244
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcacgaucccguccgccaaggccagcauccugcacgaggugaagcccgucaccuccggcugcuuccccaucaugcacgaccggaccaagauccgccagcugcccaaccuccugcggggguacgagcacauccgccugagcacccacaacgugaucaacgcggagacggccccgggcgggcccuacaaggugggcaccuccgggagcugccccaacgucaccaacggcaacggcuucuucgccaccauggccugggcggugcccaagaacgacaacaacaagacggccaccaacccgcucaccguggagguccccuacaucugcaccgagggggaggaccagaucacgguguggggcuuccacuccgacaacgaggcccagauggugaagcuguacggggacagcaagccccagaaguucaccuccagcgccaacggcgucaccacccacuacgugucccagaucggcggguuccccaaccaggccgaggacggcgggcugccgcagagcggccggaucguggucgacuacauggugcagaaguccgggaagacgggcaccaucaccuaccagcgcggcauccuccugccccagaagguguggugcgcgagcgggcgguccaaggucaucaagggcagccugccccucaucggggaggccgacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgcgaagcugcucaaggagaagggcuucuucggggccaucgccggcuuccuggagggcgggugggagggcaugaucgccggguggcacggcuacaccucccacggggcccacggcgucgcgguggccgccgaccugaaguccacccaggaggccaucaacaagaucacgaagaaccucaacucccugagcgagcuggaggugaagaaccuccagcggcuguccggcgccauggacgagcugcacaacaagauccucgagcuggacgagaaggucgacgaccugcgcgcggacaccaucagcucccagaucgagcucgccgugcugcugagcaacgaggggaucaucaacuccgaggacgagcaccuccuggcccuggagcggaagcucaagaagaugcugggccccagcgccguggagaucgggaacggcugcuucgagaccaagcacaagugcaaccagaccugccuggaccgcaucgcggccgggaccuucaacgccggcgaguucucccuccccacguucgacagccugaacaucaccgccgccucccugaacgacgacggccucgacaaccacaccauccugcuguacuacagcaccgcggccuccagccuggccgucacgcucaugaucgccaucuucaucguguacauggugucccgggacaacgucagcugcuccaucugccuguga

SEQ ID NO: 87474 - RNA, 1752 nt, Artificial Sequence
  derived and/or modified sequence opt1 from hemagglutinin__InfluenzaB__ABL77255
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaugggcaccaucccguccgccaaggccagcauccugcacgaggugcggcccgucacguccggcugcuuccccaucaugcacgaccgcaccaagauccggcagcugcccaaccuccugcgcggguacgagaacauccggcugagcacccacaacgugaucaacgcggagcgcgccccgggcgggcccuaccggcucggcaccuccgggagcugccccaacgugacgucccgcaacggcuucuucgccaccauggccugggcggucccccgggacaacaagaccgccaccaacccgcugacgguggaggugcccuacaucugcaccaagggcgaggaccagaucaccgucuggggguuccacagcgacgacaagacccagaugaagaaccuguacggcgacuccaacccccagaaguucacgagcuccgccaacggggugaccacccacuacgugagccagaucggcgacuuccccaaccagaccgaggacggcgggcucccgcaguccggccgcaucgucguggacuacauggugcagaagcccgggaagacgggcaccaucgucuaccagcgcggggugcugcugccccagaagguguggugcgccagcggccgguccaaggucaucaagggcagccucccccugaucggggaggccgacugccugcacgagaaguacggcgggcucaacaagagcaagccguacuacaccggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccacggcgucgccguggccgcggaccucaagagcacccaggaggccaucaacaagaucaccaagaaccugaacucccugagcgagcucgaggugaagaaccugcagcggcuguccggggccauggacgagcuccacaacgagauccuggagcuggacgagaaggucgacgaccuccgcgccgacacgaucagcucccagaucgagcuggccgugcugcucagcaacgagggcaucaucaacuccgaggacgagcaccuccuggcgcuggagcggaagcugaagaagaugcugggccccagcgccguggacaucgggaacggcugcuucgagaccaagcacaagugcaaccagaccugccucgaccgcaucgccgccgggaccuucaacgcgggcgaguucucccugcccaccuucgacagccugaacaucacggccgccucccucaacgacgacgggcuggacaaccacaccauccugcuguacuacagcaccgccgccuccagccucgcggucacccugaugaucgccaucuucaucguguacauggugucccgggacaacgucagcugcuccaucugccuguga

SEQ ID NO: 87475 - RNA, 1752 nt, Artificial Sequence
  derived and/or modified sequence opt1 from hemagglutinin__InfluenzaB__ABL77266
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagcgcgccccgggcgggcccuaccggcucggcacguccgggagcugccccaacgucaccucccgcgacggcuucuucgccaccauggccugggcggugccccgggacaacaagaccgccacgaacccgcugaccguggagguccccuacaucugcaccaagggcgaggaccagaucaccguguggggguuccacagcgacuccaagacgcagaugaagaaccuguacggcgacagcaacccccagaaguucaccuccagcgccaacggggugaccacccacuacgucucccagaucggcggcuuccccaaccagacggaggacgggggccucccgcagagcgggcgcaucgugguggacuacaugguccagaagcccggcaagaccgggaccaucguguaccagcggggcgugcugcugccccagaaggucuggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccguggccgcggaccucaaguccacccaggaggccaucaacaagaucacgaagaaccugaacagccuguccgagcucgaggucaagaaccugcagcggcugagcggcgccauggacgagcuccacaacgagauccuggagcuggacgagaagguggacgaccuccgcgccgacaccaucuccagccagaucgagcuggccgugcugcucuccaacgagggcaucaucaacagcgaggacgagcaccuccuggcgcuggagcggaagcugaagaagaugcuggggcccuccgccgucgacaucggcaacgggugcuucgagaccaagcacaagugcaaccagaccugccucgaccgcaucgccgccggcaccuucaacgcgggggaguucagccugcccacguucgacucccugaacaucaccgccgccagccucaacgacgacggccuggacaaccacaccauccugcuguacuacuccaccgccgccagcucccucgcggugacgcugaugaucgccaucuucaucguguacauggucagccgggacaacguguccugcagcaucugccuguga

SEQ ID NO: 87476 - RNA, 1752 nt, Artificial Sequence
  derived and/or modified sequence opt1 from hemagglutinin__InfluenzaB__ABL77277
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaacaccccguccgccaaggccagcauccugcacgagguccggcccgugacguccggcugcuuccccaucaugcacgaccgcaccaagauccggcagcugcccaaccuccugcgcggguacgagaacauccggcugagcacccagaacgugaucaacgcggagcgcgccccgggcgggcccuaccggcucggcaccuccgggagcugccccaacgucacgaaccgcgacggcuucuucgccaccauggccugggcggugccccgggacaacaagaccgccaccaacccgcugacgguggagguccccuacaucugcaccaagggcgaggaccagaucaccguguggggguuccacuccgacaacaagauccagaugaagaaccuguacggcgacagcaacccccagaaguucaccuccagcgccaacggggugacgacccacuacgucucccagaucggcggcuuccccaaccagaccgaggacgggggccucccgcagagcgggcgcaucgugguggacuacaugguccagaagcccggcaagaccgggacgaucguguaccagcggggcgugcugcugccccagaaggucuggugcgccuccggccgcagcaaggugaucaaggggucccucccccugaucggcgaggccgacugccugcacgagaaguacgggggccucaacaagagcaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccguggccgcggaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacaccaucuccagccagaucgagcuggccgugcugcucuccaacgagggcaucaucaacagcgaggacgagcaccuccuggcgcuggagcggaagcugaagaagaugcuggggcccuccgccgucgacaucggcaacgggugcuucgagacgaagcacaagugcaaccagaccugccucgaccgcaucgccgccggcaccuucaacgcgggggaguucagccugcccaccuucgacucccugaacaucaccgccgccagccucaacgacgacggccuggacaaccacacgauccugcuguacuacuccaccgccgccagcucccucgcggugacccugaugaucgccaucuucaucguguacauggucagccgggacaacguguccugcagcaucugccuguga

SEQ ID NO: 87477 - RNA, 1752 nt, Artificial Sequence
  derived and/or modified sequence opt1 from hemagglutinin__InfluenzaB__ABL77288
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagcacauccggcugagcacccagaacgugaucaacgcggagaaggccccgggcgggcccuacaagcucggcacguccgggagcugccccaacgccaccucccgcagcggcuucuucgccaccauggcgugggccgucccccgggacaacaagaccgccacgaacccgcugaccguggaggugcccuacaucugcaccaagggcgaggaccagaucaccgucuggggguuccacuccgacacgaagacccagaugaagaaccuguacggcgacagcaacccccagaaguucaccuccagcgccaacggggugaccacgcacuacgugucccagaucggcggcuuccccgaccagaccgaggacgggggccucccgcagagcgggcgcaucgucguggacuacauggugcagaagcccggcaagaccgggaccaucgucuaccagcggggcgugcugcugccccagaagguguggugcgccuccggccgcagcaaggucaucaaggggagccucccccugaucggcgaggcggacugccugcacgagaaguacgggggccucaacaaguccaagccguacuacacgggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcacguucaacgccggggaguucagccugcccaccuucgacucccugaacaucaccgccgccagccucaacgacgacggccuggacaaccacaccauccugcuguacuacuccacggccgcgagcucccucgccgucacccugaugaucgccaucuucaucguguacauggugagccgggacaacgucuccugcagcaucugccuguga

SEQ ID NO: 87478 - RNA, 1752 nt, Artificial Sequence
  derived and/or modified sequence opt1 from hemagglutinin__InfluenzaB__ABL77299
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaacaucccguccgccaaggccagcauccugcacgaggugcggcccgucaccuccggcugcuuccccaucaugcacgaccgcacgaagauccggcagcugcccaaccuccugcgcggguacgagcacauccggcugagcacccacaacgugaucaacgcggagcgcgccccgggcgggcccuaccggcucggcaccuccgggagcugccccaacgugaccucccgcagcggcuucuucgccacgauggccugggcggucccccgggacaacaagaccgccaccaacccgcugaccguggaggugcccuacaucugcacgaagggcgaggaccagaucaccgucuggggguuccacuccgacaacgagacccagaugaagaaccuguacggcgacagcaacccccagaaguucaccuccagcgccaacgggaucacgacccacuacgugucccagaucggcggcuuccccaaccagaccgaggacgggggccucccgcagagcgggcgcaucguggucgacuacauggugcagaagcccggcaagaccgggacgaucguguaccagcggggcguccugcugccccagaagguguggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcgcuggagcggaagcugaagaagaugcuggggcccuccgccguggacaucggcaacgggugcuucgagacgaagcacaagugcaaccagaccugccucgaccgcaucgccgccggcaccuucaacgcgggggaguucagccugcccaccuucgacucccugaacaucaccgccgccagccucaacgacgacggccuggacaaccacacgauccugcuguacuacuccaccgccgccagcucccucgcggugacccugaugaucgccaucuucaucgucuacauggugagccgggacaacguguccugcagcaucugccuguga

SEQ ID NO: 87479 - RNA, 1752 nt, Artificial Sequence
  derived and/or modified sequence opt1 from hemagglutinin__InfluenzaB__ABL77310
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacaacaagaaccagaugaagaaccuguacggcgacagcaacccccagaaguucaccuccagcgccaacggggugacgacccacuacgugucccagaucggcggcuuccccaaccagaccgaggacgggggccucccgcagagcgggcgcaucgucguggacuacauggugcagaagcccggcaagaccgggacgaucgucuaccagcggggcgugcugcugccccagaagguguggugcgucuccggccgcagcaaggugaucaaggggagccucccccugaucggcgaggccgacugccugcacgagaaguacgggggccucaacaaguccaagccguacuacaccggggagcacgccaaggcgaucggcaacugccccaucugggucaagacgccccugaagcuggccaacggcaccaaguaccggcccccggccaagcuccugaaggagcgcggguucuucggcgccaucgccggguuccuggagggcgggugggagggcaugaucgcgggcuggcacggguacaccagccacggcgcccacgggguggccguggccgccgaccucaaguccacccaggaggcgaucaacaagaucaccaagaaccugaacagccuguccgagcucgaggucaagaaccugcagcggcugagcggcgccauggacgagcuccacaacgagauccuggagcuggacgagaagguggacgaccuccgcgccgacaccaucuccagccagaucgagcuggccgugcugcucuccaacgagggcaucaucaacagcgaggacgagcaccuccuggcccuggagcggaagcugaagaagaugcuggggcccuccgcggucgacaucggcaacgggugcuucgagacgaagcacaagugcaaccagaccugccucgaccgcaucgccgccggcaccuucaacgccggggaguucagccugcccaccuucgacucccugaacaucaccgcggccagccucaacgacgacggccuggacaaccacacgauccugcuguacuacuccaccgccgccagcucccucgccgugacccugaugaucgcgaucuucaucguguacauggucagccgggacaacguguccugcagcaucugccuguga

SEQ ID NO: 87480 - RNA, 1758 nt, Artificial Sequence
  derived and/or modified sequence opt1 from hemagglutinin__InfluenzaB__ABL77321
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcacgaucccguccgccaaggugagcauccugcacgaggucaagcccgugaccuccggcugcuuccccaucaugcacgaccggaccaagauccgccagcugcccaaccuccugcggggguacgagcacauccgccugagcacccacaacgugaucaacgccgagaaggcgccgggcgggcccuacaagaucggcacguccgggagcugccccaacaucaccaacggcaacggcuucuucgccaccauggccugggccguccccaagaacgacaacaacaagaccgcgacgaacucccucaccguggaggugccguacaucugcaccgagggggaggaccagaucaccgucuggggcuuccacagcgacaacgagacgcagauggccaagcuguacggggacuccaagccccagaaguucaccagcuccgccaacggcgugaccacccacuacgugagccagaucggcggguuccccaaccaggccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagacgccgcucaaccuggccaacgggaccaaguaccgcccgcccgccaagcugcucaaggagcggggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuucaacgccggcgaguucagccuccccacguucgacucccugaacaucaccgccgccagccugaacgacgacggccucgacaaccacaccauccugcuguacuacuccaccgccgcgagcucccuggccgugacgcucaugaucgccaucuucaucguguacauggucagccgcgacaacguguccugcagcaucugccuguga

SEQ ID NO: 87481 - RNA, 1755 nt, Artificial Sequence
  derived and/or modified sequence opt1 from hemagglutinin__InfluenzaB__ABL77332
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuacaagcucggcacguccgggagcugccccaacgccaccucccgcagcggcuucuucgccaccauggcgugggccgucccccgggacaacaacaagaccgccacgaacccgcugaccguggaggugcccuacaucugcaccaagggcgaggaccagaucaccgucuggggguuccacuccgacgacaagacgcagaugaagaaccuguacggcgacagcaacccccagaaguucaccuccagcgccaacggggugaccacccacuacgugucccagaucggcggcuuccccgaccagacggaggacgggggccucccgcagagcgggcgcaucgucguggacuacauggugcagaagcccggcaagaccgggaccaucgucuaccagcggggcgugcugcugccccagaagguguggugcgccuccggccgcagcaaggucaucaaggggagccucccccugaucggcgaggcggacugccugcacgagaaguacgggggccucaacaaguccaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucacgaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccacguucgacucccugaacaucaccgccgccagccucaacgacgacggccuggacaaccacgccauccugcuguacuacuccaccgcggccagcucccucgccgucacccugaugaucgccaucuucaucguguacauggugagccgggacaacgucuccugcagcaucugccuguga

SEQ ID NO: 87482 - RNA, 1755 nt, Artificial Sequence
  derived and/or modified sequence opt1 from hemagglutinin__InfluenzaB__ABL77343
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacaucugcaccaagggcgaggaccagaucaccgucuggggguuccacuccgacaacaagauccagaugaagaaccuguacggcgacagcaacccccagaaguucacguccagcgccaacggggugaccacccacuacgugucccagaucggcggcuuccccgaccagaccgaggacgggggccucccgcagagcgggcggaucgucguggacuacauggugcagaagcccggcaagacggggaccaucgucuaccagcgcggcgugcugcugccccagaagguguggugcgccuccggccggagcaaggucgugaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacacgaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugaucgccaucuucaucguguacauggucagccgcgacaacguguccugcagcaucugccuguga

SEQ ID NO: 87483 - RNA, 1755 nt, Artificial Sequence
  derived and/or modified sequence opt1 from hemagglutinin__InfluenzaB__ABL77365
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacgucugcaccgagggcgaggaccagaucaccguguggggguuccacuccgacaacaagacgcagaugaagaaccuguacggcgacagcaacccccagaaguucaccuccagcgccaacggggugaccacccacuacgucucccagaucggcggcuuccccgaccaggccgaggacgggggccucccgcagagcgggcggaucgugguggacuacaugguccagaagcccggcaagacggggaccaucguguaccagcgcggcgugcugcugccccagaaggucuggugcgcguccggccggagcaaggugaucaaggggagccucccccugaucggcgaggccgacugccugcacgagaaguacgggggccucaacaaguccaagccguacuacaccggggagcacgccaaggccaucggcaacugccccaucugggucaagacgccccugaagcuggccaacggcaccaaguaccggcccccggcgaagcuccugaaggagcgcggguucuucggcgccaucgccggguuccuggagggcgggugggagggcaugaucgccggcuggcacggguacaccagccacggcgcccacgggguggcgguggccgccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggcggacacgaucuccagccagaucgagcuggccgugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugaucgccaucuucaucguguacauggucagccgcgacaacguguccugcagcaucugccuguga

SEQ ID NO: 87484 - RNA, 1755 nt, Artificial Sequence
  derived and/or modified sequence opt1 from hemagglutinin__InfluenzaB__ABL84340
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacaccaccuccaagagcggcuucuucgccaccauggccugggcggucccccgggacaacaacaagacggccaccaacccgcugaccguggaggugccccacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagccucccccugaucggggaggccgacugccugcacgagaaguacggcgggcucaacaaguccaagccguacuacacgggcgagcacgcgaaggccaucgggaacugccccaucugggucaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccagccacggggcccacggcguggccgucgccgcggaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcgcuggagcggaagcugaagaagaugcugggccccuccgccguggacaucgggaacggcugcuucgagaccaagcacaagugcaaccagaccugccucgaccgcaucgccgccgggacguucaacgcgggcgaguucagccugcccaccuucgacucccugaacaucaccgccgccagccucaacggggacggccuggacaaccacaccauccugcuguacuacuccacggccgccagcucccucgcggugacccugaugaucgccaucuucaucgucuacaugaucagccgggacaacguguccugcagcaucugccuguga

SEQ ID NO: 87485 - RNA, 1755 nt, Artificial Sequence; identical to SEQ ID NO: 87406
  derived and/or modified sequence opt1 from hemagglutinin__InfluenzaB__ABN50382

SEQ ID NO: 87486 - RNA, 1755 nt, Artificial Sequence; identical to SEQ ID NO: 87406
  derived and/or modified sequence opt1 from hemagglutinin__InfluenzaB__ABN50393

SEQ ID NO: 87487 - RNA, 1755 nt, Artificial Sequence
  derived and/or modified sequence opt1 from hemagglutinin__InfluenzaB__ABN50404
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugccccgcgacaacaacaagaccgccacgaacccgcugaccguggaggucccccacaucugcaccaaggaggaggaccagaucaccguguggggcuuccacuccgacaacaagacgcagaugaagaaccuguacggggacagcaacccccagaaguucaccuccagcgccaacggcgugaccacccacuacgucucccagaucgggggcuuccccgaccagacggaggacggcgggcucccgcagagcggccggaucgugguggacuacaugguccagaagcccgggaagaccggcaccaucguguaccagcgcgggauccugcugccccagaagguguggugcgccuccggccggagcaaggucaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgucacgcugaugaucgccaucuucaucguguacaugaucagccgcgacaacguguccugcagcaucugccuguga

SEQ ID NO: 87488 - RNA, 1755 nt, Artificial Sequence; identical to SEQ ID NO: 87415
  derived and/or modified sequence opt1 from hemagglutinin__InfluenzaB__ABN50415

SEQ ID NO: 87489 - RNA, 1755 nt, Artificial Sequence; identical to SEQ ID NO: 87415
  derived and/or modified sequence opt1 from hemagglutinin__InfluenzaB__ABN50426

SEQ ID NO: 87490 - RNA, 1755 nt, Artificial Sequence
  derived and/or modified sequence opt1 from hemagglutinin__InfluenzaB__ABN50437
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgaccccaacccccagaaguucacgagcuccgccaacggggugaccacccacuacgugagccagaucggcggcuucccggaccagaccgaggacgggggccucccccaguccgggcgcaucgucguggacuacaugaugcagaagcccggcaagacggggaccaucguguaccagcggggcguccugcugccccagaagguguggugcgccagcggcaaguccaaggugaucaaggggagccucccgcugaucggcgaggcggacugccugcacgagaaguacgggggccucaacaagagcaagcccuacuacaccggggagcacgccaaggccaucggcaacugccccaucugggucaagacgccccugaagcuggccaacggcaccaaguaccgcccgcccgccaagcuccugaaggagcggggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcgccuguccggcgccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcuggggcccagcgccguggacaucggcaacgggugcuucgagaccaagcacaagugcaaccagaccugccucgaccggaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgcgacaacgugagcugcuccaucugccucuga

SEQ ID NO: 87491 - RNA, 1758 nt, Artificial Sequence
  derived and/or modified sequence opt1 from hemagglutinin__InfluenzaB__ABN50459
augaaggcccugaucgugcuccugauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccucaaggggacgaagacccggggcaagcugugccccaagugccugaacugcaccgaccucgacguggcccuggggcgccccaagugcaccggcaacaucccguccgccgaggugagcauccugcacgagguccggcccgugacguccggcugcuuccccaucaugcacgaccgcaccaagauccggcagcuccccaaccugcugcgcggguacgagcacauccggcucagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccaucuggggcuuccacagcgacaacgagauccagauggccaagcuguacggggacuccaagccccagaaguucaccagcuccgccaacggcgucacgacccacuacgugagccagaucggcggguuccccaaccagaccgaggacggcgggcucccccaguccggccgcaucguggucgacuacauggugcagaaguccgggaagaccggcacgaucaccuaccagcggggcauccugcugccgcagaagguguggugcgccuccgggcgcagcaaggucaucaagggcagccucccccugaucggggaggccgacugccugcacgagaaguacggcgggcucaacaaguccaagcccuacuacaccggcgagcacgcgaaggccaucggcaacugccccaucugggugaagaccccgcugaagcuggccaacgggacgaaguaccggccgcccgccaagcuccugaaggagcgcggcuucuucggggccaucgcgggcuuccuggagggcgggugggagggcaugaucgccggguggcacggcuacaccagccacggggcccacggcguggccgucgccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacacgaucuccagccagaucgagcuggccgugcugcucuccaacgaggggaucaucaacagcgaggacgagcaccuccuggcgcuggagcggaagcugaagaagaugcugggccccuccgccguggagaucgggaacggcugcuucgagaccaagcacaagugcaaccagaccugccucgaccgcaucgccgccgggaccuucgacgcgggcgaguucagccugcccaccuucgacucccugaacaucacggccgccagccucaacgacgacggccuggacaaccacaccauccugcuguacuacuccaccgccgccagcucccucgcggucacccugaugaucgccaucuucgugguguacauggucagccgggacaacguguccugcagcaucugccuguga

SEQ ID NO: 87492 - RNA, 1758 nt, Artificial Sequence
  derived and/or modified sequence opt1 from hemagglutinin__InfluenzaB__ABN50470
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgagauccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacacgagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuucaacgcgggcgaguucagccuccccaccuucgacucccugaacaucaccgccgccagccugaacgacgacggccucgacaaccacacgauccugcuguacuacuccaccgccgccagcucccuggcggugacccucaugaucgccaucuucguggucuacauggugagccgcgacaacguguccugcagcaucugccuguga

SEQ ID NO: 87493 - RNA, 1755 nt, Artificial Sequence
  derived and/or modified sequence opt1 from hemagglutinin__InfluenzaB__ABN50481
augaaggccaucaucgugcugcuccuggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccucaaggggacgaagacccggggcaagcugugcccgaccugcuucaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucgacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 87494 - RNA, 1755 nt, Artificial Sequence
  derived and/or modified sequence opt1 from hemagglutinin__InfluenzaB__ABN50503
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcgucacgcccuccgccaaggccagcauccugcacgaggugcggcccgugaccuccggcugcuuccccaucaugcacgaccgcaccaagauccggcagcugcccaaccuccugcgcggguacgagaagauccggcugagcacccagaacgucaucaacgcggagaaggccccgggcgggcccuaccgccucggcacguccgggagcugccccaacgccaccucccggagcggcuucuucgccaccauggcgugggccgugcccaaggacaacaacaagaccgccacgaacccgcugaccguggaggucccccacaucugcaccaaggaggaggaccagaucaccguguggggcuuccacuccgacgacaagacgcagaugaagaaccuguacggggacagcaacccccagaaguucaccuccagcgccaacggcgugaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgccuccggccgcagcaaggucaucaagggcagccucccccugaucggggaggcggacugccugcacgagaaguacggcgggcucaacaaguccaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgucacgcugaugaucgccaucuucaucguguacaugaucagccgggacaacguguccugcagcaucugccuguga

SEQ ID NO: 87495 - RNA, 1755 nt, Artificial Sequence
  derived and/or modified sequence opt1 from hemagglutinin__InfluenzaB__ABN50514
augaaggccaucaucgugcugcucauggucgccaccagcaacgcggaccgcaucugcaccggcaucacguccagcaacagcccccacguggugaagaccgccacccagggggaggucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagagcggcuucuucgcgaccauggccugggccgugcccaaggacaacaacaagaacgccaccaacccgcugacggucgaggugcccuacgugugcaccgagggcgaggaccagaucaccgucuggggguuccacuccgacaacaagccccagaugaagaaccuguacggcgacagcaacccccagaaguucaccuccagcgccaacggggugacgacccacuacgugucccagaucggcggcuucccggaccagaccgaggacgggggccucccccagagcgggcgcaucgucguggacuacauggugcagaagcccggcaagaccgggacgaucgucuaccagcggggcgugcugcugccccagaagguguggugcgcguccggccgcagcaaggucaucaaggggagccucccgcugaucggcgaggccgacugccugcacgagaaguacgggggccucaacaaguccaagcccuacuacaccggggagcacgccaaggccaucggcaacugccccaucugggugaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacggggucgcgguggccgccgaccucaaguccacccaggaggccaucaacaagaucaccaagaaccugaacagccuguccgagcucgaggugaagaaccugcagcggcugagcggcgccauggacgagcuccacgacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgucacccugaugcuggccaucuucaucguguacauggugagccgggacaacgucuccugcagcaucugccucuga

SEQ ID NO: 87496 - RNA, 1755 nt, Artificial Sequence
  derived and/or modified sequence opt1 from hemagglutinin__InfluenzaB__ABN50525
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucuccaccauggccugggcgguccccaaggacaacaacaagaacgccaccaacccgcugacgguggaggugcccuacgucugcaccgagggcgaggaccagaucaccguguggggguuccacagcgacaacaagacccagaugaagaaccuguacggcgacuccaacccccagaaguucacgagcuccgccaacggggugaccacccacuacgucagccagaucggcggcuuccccgaccagaccgaggacgggggccucccgcaguccgggcgcaucgugguggacuacaugguccagaagcccggcaagacggggaccaucguguaccagcggggcgugcugcugccccagaaggucuggugcgccagcggccgcagcaaggugaucaaggggucccucccccugaucggcgaggccgacugccugcacgagaaguacgggggccucaacaagagcaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacgggguggccguggccgcggaccucaagagcacccaggaggccaucaacaagaucaccaagaaccugaacucccugagcgagcucgaggucaagaaccugcagcggcuguccggcgccauggacgagcuccacaacgagauccuggagcuggacgagaagguggacgaccuccgcgccgacacgaucagcucccagaucgagcuggccgugcugcucagcaacgagggcaucaucaacuccgaggacgagcaccuccuggcgcuggagcggaagcugaagaagaugcuggggcccagcgccgucgacaucggcaacgggugcuucgagaccaagcacaagugcaaccagaccugccucgaccgcaucgccgccggcaccuucaacgcgggggaguucucccugcccaccuucgacagccugaacaucacggccgccucccucaacgacgacggccuggacaaccacaccauccugcuguacuacagcaccgccgccuccagccucgcggugacccugaugcuggccaucuucaucguguacauggucucccgggacaacgugagcugcagcaucugccucuga

SEQ ID NO: 87497 - RNA, 1758 nt, Artificial Sequence
  derived and/or modified sequence opt1 from hemagglutinin__InfluenzaB__ABN50536
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgaggaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgagauccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacacgagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuucaacgcgggcgaguucagccuccccaccuucgacucccugaacaucaccgccgccagccugaacgacgacggccucgacaaccacacgauccugcuguacuacuccaccgccgccagcucccuggcggugacccucaugaucgccaucuucguggucuacauggugagccgcgacaacguguccugcagcaucugccuguga

SEQ ID NO: 87498 - RNA, 1758 nt, Artificial Sequence
  derived and/or modified sequence opt1 from hemagglutinin__InfluenzaB__ABN50547
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagcugaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcucccccaguccggccgcaucgucguggacuacauggugcagaaguccgggaagaccggcacgaucaccuaccagcggggcauccugcugccgcagaaggucuggugcgccuccgggcgcagcaaggugaucaagggcagccucccccugaucggggaggccgacugccugcacgagaaguacggcgggcucaacaaguccaagcccuacuacaccggcgagcacgcgaaggccaucggcaacugccccaucugggugaagaccccgcugaagcuggccaacgggacgaaguaccggccgcccgccaagcuccugaaggagcgcggcuucuucggggccaucgcgggcuuccuggagggcgggugggagggcaugaucgccggguggcacggcuacaccagccacggggcccacggcgucgccguggccgcggaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggccgugcugcucuccaacgaggggaucaucaacagcgaggacgagcaccuccuggcgcuggagcggaagcugaagaagaugcugggccccuccgccgucgagaucgggaacggcugcuucgagaccaagcacaagugcaaccagaccugccucgaccgcaucgccgccgggaccuucgacgcgggcgaguucagccugcccaccuucgacucccugaacaucacggccgccagccucaacgacgacggccuggacaaccacaccauccugcuguacuacuccaccgccgccagcucccucgcggugacccugaugaucgccaucuucguggucuacauggugagccgggacaacguguccugcagcaucugccuguga

SEQ ID NO: 87499 - RNA, 1758 nt, Artificial Sequence
  derived and/or modified sequence opt1 from hemagglutinin__InfluenzaB__ABN50558
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaaggagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacaugaugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 87500 - RNA, 1755 nt, Artificial Sequence; identical to SEQ ID NO: 87415
  derived and/or modified sequence opt1 from hemagglutinin__InfluenzaB__ABN50569

SEQ ID NO: 87501 - RNA, 1758 nt, Artificial Sequence; identical to SEQ ID NO: 87427
  derived and/or modified sequence opt1 from hemagglutinin__InfluenzaB__ABN50580

SEQ ID NO: 87502 - RNA, 1758 nt, Artificial Sequence
  derived and/or modified sequence opt1 from hemagglutinin__InfluenzaB__ABN50591
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgaggcccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucaacgccggcgaguucagccuccccaccuucgacucccugaacaucaccgccgccagccugaacgacgacggccucgacaaccacacgauccugcuguacuacuccaccgccgcgagcucccuggccgugacccucaugaucgccaucuucguggucuacauggugagccgcgacaacguguccugcagcaucugccuguga

SEQ ID NO: 87503 - RNA, 1758 nt, Artificial Sequence
  derived and/or modified sequence opt1 from hemagglutinin__InfluenzaB__ABN50602
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaugggcaccaucccguccgccaaggccagcauccugcacgaggugaagcccgucacguccggcugcuuccccaucaugcacgaccggaccaagauccgccagcugcccaaccuccugcggggguacgagaacauccgccugagcacccacaacgugaucaacgcggagaccgccccgggcgggcccuacaagaucggcacguccgggagcugccccaacaucaccaacggcaacggcuucuucgccaccauggccugggcggugcccaagaacgacaacaacaagaccgccacgaacccgcucaccgucgaggugcccuacaucugcaccgagggggaggaccagaucaccguguggggcuuccacuccgacaacgagacgcagauggucaagcuguacggggacagcaagccccagaaguucaccuccagcgccaacggcgugaccgcccacuacgugucccagaucggcggguuccccaaccaggccgaggacggcgggcugccgcagagcggccggaucgucguggacuacauggugcagaaguccgggaagaccggcacgaucaccuaccagcgcggcauccuccugccccagaaggucuggugcgcgagcgggcgguccaaggugaucaagggcagccugccccucaucggggaggccgacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgcgaagcugcucaaggagcggggcuucuucggggccaucgccggcuuccuggagggcgggugggagggcaugaucgccggguggcacggcuacaccucccacggggcccacggcgucgcgguggccgccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggcggacacgaucagcucccagaucgagcucgccgugcugcugagcaacgaggggaucaucaacuccgaggacgagcaccuccuggcccuggagcgcaagcucaagaagaugcugggccccagcgccgucgacaucgggaacggcugcuucgagaccaagcacaagugcaaccagaccugccuggaccggaucgcggccgggaccuucaacgccggcgaguucucccuccccaccuucgacagccugaacaucacggccgccucccugaacgacgacggccucgacaaccacaccauccugcuguacuacagcaccgcggccuccagccuggccgugacccucaugaucgccaucuucaucguguacauggucucccgcgacaacgugagcugcuccaucugccuguga

SEQ ID NO: 87504 - RNA, 1752 nt, Artificial Sequence
  derived and/or modified sequence opt1 from hemagglutinin__InfluenzaB__ABN50624
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagaacauccggcugagcacccacaacgugaucaacgcggagcgcgccccgggcgggcccuaccggcucggcaccuccgggagcugccccaacgugacguccaagagcggcuucuucgccaccauggccugggcggucccccgcgacaacaagaccgccaccaacccgcugacgguggaggugcccuacaucugcaccaagggcgaggaccagaucaccgucuggggguuccacuccgacaacaagaaccagaugaagaaccuguacggcgacagcaacccccagaaguucaccuccagcgugaacggggugacgacccacuacgucucccagaucggcggcuuccccaaccagaccgaggacgggggccucccgcagagcgggcggaucgugguggacuacaugguccagaagcccggcaagaccgggacgaucguguaccagcgcggcgugcugcugccccagaaggucuggugcgccuccggccggagcaaggugaucaaggggagccucccccugaucggcgaggccgacugccugcacgagaaguacgggggccucaacaaguccaagccguacuacaccggggagcacgccaaggcgaucggcaacugccccaucugggucaagacgccccugaagcuggccaacggcaccaaguaccggcccccggccaagcuccugaaggagcgcggguucuucggcgccaucgccggguuccuggagggcgggugggagggcaugaucgcgggcuggcacggguacaccagccacggcgcccacgggguggccguggccgccgaccucaaguccacccaggaggcgaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcggucgacaucggcaacgggugcuucgagacgaagcacaagugcaaccagaccugccucgaccggaucgccgccggcaccuucaacgccggggaguucagccugcccaccuucgacucccugaacaucaccgcggccagccucaacgacgacggccuggacaaccacacgauccugcuguacuacuccaccgccgccagcucccucgccgugacccugaugaucgcgaucuucaucguguacauggucagccgcgacaacguguccugcagcaucugccuguga

SEQ ID NO: 87505 - RNA, 1752 nt, Artificial Sequence
  derived and/or modified sequence opt1 from hemagglutinin__InfluenzaB__ABN50635
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacagcaagacccagaugaagaaccuguacggcgacuccaacccccagaaguucacgagcuccgccaacggggugaccacccacuacgugagccagaucggcggcuuccccaaccagaccgaggacgggggccucccgcaguccgggcgcaucgucguggacuacauggugcagaagcccggcaagacggggaccaucgucuaccagcggggcgugcugcugccccagaagguguggugcgccagcggccgcagcaaggucaucaaggggucccucccccugaucggcgaggccgacugccugcacgagaaguacgggggccucaacaagagcaagccguacuacaccggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacggggucgccguggccgcggaccucaagagcacccaggaggccaucaacaagaucaccaagaaccugaacucccugagcgagcucgaggugaagaaccugcagcggcuguccggcgccauggacgagcuccacaacgagauccuggagcuggacgagaaggucgacgaccuccgcgccgacacgaucagcucccagaucgagcuggccgugcugcucagcaacgagggcaucaucaacuccgaggacgagcaccuccuggcgcuggagcggaagcugaagaagaugcuggggcccagcgccguggacaucggcaacgggugcuucgagaccaagcacaagugcaaccagaccugccucgaccgcaucgccgccggcaccuucaacgcgggggaguucucccugcccaccuucgacagccugaacaucacggccgccucccucaacgacgacggccuggacaaccacaccauccugcuguacuacagcaccgccgccuccagccucgcggucacccugaugaucgccaucuucaucguguacauggugucccgggacaacgucagcugcagcaucugccuguga

SEQ ID NO: 87506 - RNA, 1752 nt, Artificial Sequence
  derived and/or modified sequence opt1 from hemagglutinin__InfluenzaB__ABN50646
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacaacaagaaccagaugaagaaccuguacggcgacagcaacccccagaaguucaccuccagcgccaacggggugacgacccacuacgugucccagaucggcggcuuccccaaccagaccgaggacgggggccucccgcagagcgggcgcaucgucguggacuacauggugcagaagcccggcaagaccgggacgaucgucuaccagcggggcgugcugcugccccagaagguguggugcgccuccggccgcagcaaggucaucaaggggagccucccccugaucggcgaggccgacugccugcacgagaaguacgggggccucaacaaguccaagccguacuacaccggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacggggucgccguggccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggccgugcugcucuccaacgagggcaucaucaacagcgaggacgagcaccuccuggcgcuggagcggaagcugaagaagaugcuggggcccuccgccguggacaucggcaacgggugcuucgagacgaagcacaagugcaaccagaccugccucgaccgcaucgccgccggcaccuucaacgcgggggaguucagccugcccaccuucgacucccugaacaucaccgccgccagccucaacgacgacggccuggacaaccacacgauccugcuguacuacuccaccgccgccagcucccucgcggucacccugaugaucgccaucuucaucguguacauggugagccgggacaacgucuccugcagcaucugccuguga

SEQ ID NO: 87507 - RNA, 1752 nt, Artificial Sequence
  derived and/or modified sequence opt1 from hemagglutinin__InfluenzaB__ABN50657
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaucaccccguccgccaaggccagcauccugcacgagguccggcccgugacguccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcaccuccgggagcugccccaacgucacgucccggaccggcuucuucgccaccauggccugggcggugccccgcgacaacaagaccgccacgaacccgcugaccguggagguccccuacaucugcaccaagggcgaggaccagaucaccguguggggguuccacagcgacaacaagacgcagaugaagaaccuguacggcgacuccaacccccagaaguucaccagcuccgccaacggggugaccacccacuacgucagccagaucggcggcuuccccgaccagacggaggacgggggccucccgcaguccgggcggaucgugguggacuacaugguccagaagcccggcaagaccgggaccaucguguaccagcgcggcauccugcugccccagaagguguggugcgccagcggccgguccaaggucaucaaggggagccucccccugaucggcgaggccgacugccugcacgagaaguacgggggccucaacaagagcaagccguacuacaccggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacggggucgccguggccgcggaccucaagagcacccaggaggccaucaacaagaucacgaagaaccugaacucccugagcgagcucgaggugaagaaccugcagcgccuguccggcgccauggacgagcuccacaacgagauccuggagcuggacgagaaggucgacgaccuccgggccgacaccaucagcucccagaucgagcuggccgugcugcucagcaacgagggcaucaucaacuccgaggacgagcaccuccuggcgcuggagcgcaagcugaagaagaugcuggggcccagcgccguggacaucggcaacgggugcuucgagaccaagcacaagugcaaccagaccugccucgaccggaucgccgccggcaccuucaacgcgggggaguucucccugcccacguucgacagccugaacaucaccgccgccucccucaacgacgacggccuggacaaccacaccauccugcuguacuacagcaccgccgccuccagccucgcggucacgcugaugaucgccaucuucaucguguacauggugucccgcgacaacgucagcugcuccaucugccuguga

SEQ ID NO: 87508 - RNA, 1755 nt, Artificial Sequence
  derived and/or modified sequence opt1 from hemagglutinin__InfluenzaB__ABN50679
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacaucugcaccaagggcgaggaccagaucaccgucuggggguuccacuccgacgacaagacgcagaugaagaaccuguacggcgacagcaacccccagaaguucaccuccagcgccaacggggugaccacccacuacgugucccagaucggcggcuuccccgaccagacggaggacgggggccucccgcagagcgggcggaucgucguggacuacauggugcagaagcccggcaagaccgggaccaucgucuaccagcgcggcgugcugcugccccagaagguguggugcgccuccggccggagcaaggucaucaaggggagccucccccugaucggcgaggcggacugccugcacgagaaguacgggggccucaacaaguccaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucacgaagaaccugaacagccuguccgagcucgaggugaagaaccugcagcgccugagcggcgccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgccgcgggcaccuucaacgccggggaguucagccugcccacguucgacucccugaacaucaccgccgccagccucaacgacgacggccuggacaaccacaccauccugcuguacuacuccaccgccgcgagcucccucgccgucacgcugaugaucgccaucuucaucguguacauggugagccgcgacaacgucuccugcagcaucugccuguga

SEQ ID NO: 87509 - RNA, 1755 nt, Artificial Sequence
  derived and/or modified sequence opt1 from hemagglutinin__InfluenzaB__ABN50690
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacgucugcaccgagggcgaggaccagaucaccguguggggguuccacuccgacaacaagacgcagaugaagaaccuguacggcgacagcaacccccagaaguucaccuccagcgccaacggggugaccacccacuacgucucccagaucggcggcuuccccgaccagacggaggacgggggccucccgcagagcgggcggaucgugguggacuacaugguccagaagcccggcaagaccgggaccaucguguaccagcgcggcgugcugcugccccagaaggucuggugcgccuccggccggagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucacgaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgccgcgggcaccuucaacgccggggaguucagccugcccacguucgacucccugaacaucaccgccgccagccucaacgacgacggccuggacaaccacaccauccugcuguacuacuccaccgccgcgagcucccucgccgugacgcugaugaucgccaucuucaucguguacauggucagccgcgacaacguguccugcagcaucugccuguga

SEQ ID NO: 87510 - RNA, 1752 nt, Artificial Sequence
  derived and/or modified sequence opt1 from hemagglutinin__InfluenzaB__ABN50701
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaucaccccguccgccaaggccagcauccugcacgagguccggcccgugacguccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcaccuccgggagcugccccaacgucacgucccggaccggcuucuucgccaccauggccugggcggugccccgcgacaacaagaccgccacgaacccgcugaccguggagguccccuacaucugcaccaagggcgaggaccagaucaccguguggggguuccacagcgacaacaaggcccagaugaagaaccuguacggcgacuccaacccccagaaguucacgagcuccgccaacggggugaccacccacuacgucagccagaucggcggcuuccccgaccagaccgaggacgggggccucccgcaguccgggcggaucgugguggacuacaugguccagaagcccggcaagacggggaccaucguguaccagcgcggcauccugcugccccagaagguguggugcgccagcggccgguccaaggucaucaaggggagccucccccugaucggcgaggcggacugccugcacgagaaguacgggggccucaacaagagcaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacggggucgccguggcggccgaccucaagagcacccaggaggccaucaacaagaucaccaagaaccugaacucccugagcgagcucgaggugaagaaccugcagcgccuguccggcgccauggacgagcuccacaacgagauccuggagcuggacgagaaggucgacgaccuccgggccgacacgaucagcucccagaucgagcuggcggugcugcucagcaacgagggcaucaucaacuccgaggacgagcaccuccuggcccuggagcgcaagcugaagaagaugcuggggcccagcgccguggacaucggcaacgggugcuucgagaccaagcacaagugcaaccagaccugccucgaccggaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgucacccugaugaucgccaucuucaucguguacauggugucccgcgacaacgucagcugcuccaucugccuguga

SEQ ID NO: 87511 - RNA, 1755 nt, Artificial Sequence; identical to SEQ ID NO: 87509
  derived and/or modified sequence opt1 from hemagglutinin__InfluenzaB__ABN50712

SEQ ID NO: 87512 - RNA, 1755 nt, Artificial Sequence
  derived and/or modified sequence opt1 from hemagglutinin__InfluenzaB__ABN50723
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugcgggggacgaagacccgcggcaagcucugcccgaccugccugaacugcaccgaccuggacguggcccucgggcggcccaugugcgugggcacgacccccuccgccaaggccagcauccugcacgagguccgccccgugaccuccggcugcuuccccaucaugcacgaccggaccaagauccgccagcugcccaaccuccugcggggguacgagaagauccgccugagcacgcagaacgugaucaacgcggagaaggccccgggcgggcccuaccggcucggcaccuccgggagcugccccaacgccaccucccgcagcggcuucuucgccaccauggcgugggccgucccccgggacaacaacaagacggccaccaacccgcugaccguggaggugcccuacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagccucccccugaucggggaggcggacugccugcacgagaaguacggcgggcucaacaaguccaagccguacuacacgggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgugacccugaugaucgccaucuucaucgucuacaugaucagccgggacaacguguccugcagcaucugccuguga

SEQ ID NO: 87513 - RNA, 1755 nt, Artificial Sequence
  derived and/or modified sequence opt1 from hemagglutinin__InfluenzaB__ABN50734
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccucccggagcggcuucuucaccaccauggcgugggccgugccccgcgacaacaacaagacggccaccaacccgcugaccgucgaggugccccacaucugcaccaaggaggaggaccagaucacgguguggggcuuccacuccgacgacaagacccagaugaagaaccuguacggggacagcaacccccagaaguucaccuccagcaccaacggcaucacgacccacuacgucucccagaucgggggcuuccccgaccagaccgaggacggcgggcucccgcagagcggccggaucgugguggacuacaugguccagaagcccgggaagaccggcacgaucguguaccagcgcgggauccugcugccccagaagguguggugcgccuccggccggagcaaggucaucaagggcagccucccccugaucggggaggccgacugccugcacgagaaguacggcgggcucaacaaguccaagccguacuacaccggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccagccacggggcccacggcguggccgucgccgcggaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcgcuggagcgcaagcugaagaagaugcugggccccuccgccguggacaucgggaacggcugcuucgagaccaagcacaagugcaaccagacgugccucgaccggaucgccgccgggaccuucaacgcgggcgaguucagccugcccaccuucgacucccugaacaucaccgccgccagccucaacgacgacgggcuggacaaccacacgauccugcuguacuacuccaccgccgccagcucccucgcggucacccugaugaucgccaucuucaucguguacaugaucagccgcgacaacguguccugcagcaucugccuguga

SEQ ID NO: 87514 - RNA, 1758 nt, Artificial Sequence
  derived and/or modified sequence opt1 from hemagglutinin__InfluenzaB__ABN50745
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucaacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 87515 - RNA, 1752 nt, Artificial Sequence
  derived and/or modified sequence opt1 from hemagglutinin__InfluenzaB__ABN51184
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagaacauccggcugagcacccacaacgugaucaacgcggagcgcgccccgggcgggcccuaccggcucggcaccuccgggagcugccccaacgugacguccaagagcggcuucuucgccaccauggccugggcggucccccgcgacaacaagaccgccaccaacccgcugacgguggaggugcccuacaucugcaccaagggcgaggaccagaucaccgucuggggguuccacuccgacaacaagauccagaugaagaaccuguacggcgacagcaacccccagaaguucaccuccagcgccaacggggugacgacccacuacgugucccagaucggcggcuuccccaaccagaccgaggacgggggccucccgcagagcgggcggaucgucguggacuacauggugcagaagcccggcaagaccgggacgaucgucuaccagcgcggcgugcugcugccccagaagguguggugcgccuccggccggagcaaggucaucaaggggagccucccccugaucggcgaggccgacugccugcacgagaaguacgggggccucaacaaguccaagccguacuacaccggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacggggucgccguggccgcggaccucaaguccacccaggaggccaucaacaagaucaccaagaaccugaacagccuguccgagcucgaggugaagaaccugcagcgccugagcggcgccauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccguggacaucggcaacgggugcuucgagacgaagcacaagugcaaccagaccugccucgaccggaucgccgccggcaccuucaacgcgggggaguucagccugcccaccuucgacucccugaacaucaccgccgccagccucaacgacgacggccuggacaaccacacgauccugcuguacuacuccaccgccgccagcucccucgcggucacccugaugaucgccaucuucaucguguacauggugagccgcgacaacgucuccugcagcaucugccuguga

SEQ ID NO: 87516 - RNA, 1752 nt, Artificial Sequence
  derived and/or modified sequence opt1 from hemagglutinin__InfluenzaB__ABN51195
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagaacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuucgacaacaagauccagaugaagaaccuguacggcgacuccaacccccagaaguucaccagcuccgccaacggggugacgacccacuacgugagccagaucggcggcuuccccaaccagaccgaggacgggggccucccgcaguccgggcgcaucgucguggacuacauggugcagaagcccggcaagaccgggacgaucgucuaccagcggggcgugcugcugccccagaagguguggugcgccagcggccgcuccaaggucaucaaggggagccucccccugaucggcgaggccgacugccugcacgagaaguacgggggccucaacaagagcaagccguacuacaccggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacggggucgccguggccgcggaccucaagagcacccaggaggccaucaacaagaucaccaagaaccugaacucccugagcgagcucgaggugaagaaccugcagcggcuguccggcgccauggacgagcuccacaacgagauccuggagcuggacgagaaggucgacgaccuccgcgccgacaccaucagcucccagaucgagcuggccgugcugcucagcaacgagggcaucaucaacuccgaggacgagcaccuccuggcgcuggagcggaagcugaagaagaugcuggggcccagcgccguggacaucggcaacgggugcuucgagacgaagcacaagugcaaccagaccugccucgaccgcaucgccgccggcaccuucaacgcgggggaguucucccugcccaccuucgacagccugaacaucaccgccgccucccucaacgacgacggccuggacaaccacacgauccugcuguacuacagcaccgccgccuccagccucgcggucacccugaugaucgccaucuucaucguguacauggugucccgggacaacgucagcugcuccaucugccuguga

SEQ ID NO: 87517 - RNA, 1758 nt, Artificial Sequence
  derived and/or modified sequence opt1 from hemagglutinin__InfluenzaB__ABN58661
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcacgaucccguccgccaaggugagcauccugcacgaggucaagcccgugaccuccggcugcuuccccaucaugcacgaccggaccaagauccgccagcugcccaaccuccugcggggguacgagcacauccgccugagcacccacaacgugaucaacgccgagaaggcgccgggcgggcccuacaagaucggcacguccgggagcugccccaacgucaccaacggcaacggcuucuucgccaccauggccugggccgugcccaagaacgacaacaacaagaccgcgacgaacucccucaccguggaggucccguacaucugcaccgagggggaggaccagaucaccguguggggcuuccacagcgacaacgagacgcagauggccaagcuguacggggacuccaagccccagaaguucaccagcuccgccaacggcgugaccacccacuacgucagccagaucggcggguuccccaaccaggccgaggacggcgggcugccccaguccggccggaucgugguggacuacaugguccagaaguccgggaagacgggcaccaucaccuaccagcgcggcauccuccugccgcagaagguguggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggucaagacgccgcucaagcuggccaacgggaccaaguaccgcccgcccgccaagcugcucaaggagcggggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgcgguccugcuguccaacgaggggaucaucaacagcgaggacgagcaccuccuggcccuggagcgcaagcucaagaagaugcugggccccuccgccguggagaucgggaacggcugcuucgagaccaagcacaagugcaaccagaccugccuggaccggaucgccgcggggaccuucaacgccggcgaguucagccuccccacguucgacucccugaacaucaccgccgccagccugaacgacgacggccucgacaaccacaccauccugcuguacuacuccaccgccgcgagcucccuggccgugacgcucaugaucgccaucuucaucgucuacauggugagccgcgacaacguguccugcagcaucugccuguga

SEQ ID NO: 87518 - RNA, 1755 nt, Artificial Sequence; identical to SEQ ID NO: 87406
  derived and/or modified sequence opt1 from hemagglutinin__InfluenzaB__ABN59445

SEQ ID NO: 87519 - RNA, 1755 nt, Artificial Sequence
  derived and/or modified sequence opt1 from hemagglutinin__InfluenzaB__ABO72377
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugcuucaacugcaccgaccuggacgucgcccuggggcgccccaugugcgugggcaucacgcccuccgccaaggcgagcauccuccacgaggugcggcccgucaccuccggcugcuuccccaucaugcacgaccgcaccaagauccggcagcugcccaaccugcuccgcggguacgagaagauccggcugagcacccagaacgugaucgacgccgagaaggccccgggcgggcccuaccgccugggcacguccgggagcugccccaacgccaccuccaagagcggcuucuucgcgaccauggccugggccgugccccgggacaacaacaagaccgccacgaacccgcucaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcugccgcagagcggccgcaucgugguggacuacaugguccagaagcccgggaagaccggcaccaucguguaccagcgggggauccuccugccccagaagguguggugcgcguccggccgcagcaaggucaucaagggcagccugccccucaucggggaggccgacugccugcacgagaaguacggcgggcugaacaaguccaagccguacuacaccggcgagcacgccaaggccaucgggaacugccccaucugggugaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccagccacggggcccacggcguggcggucgccgccgaccugaaguccacccaggaggccaucaacaagaucacgaagaaccucaacagccuguccgagcuggaggugaagaaccuccagcggcugagcggggccauggacgagcugcacaacgagauccucgagcuggacgagaaggucgacgaccugcgcgcggacaccaucuccagccagaucgagcucgccgugcugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgcggccgggaccuucaacgccggcgaguucagccuccccacguucgacucccugaacaucaccgccgccagccugaacgacgacgggcucgacaaccacaccauccugcuguacuacuccaccgcggccagcucccuggccgucacgcucaugaucgccaucuucaucguguacaugaucagccgggacaacguguccugcagcaucugccuguga

SEQ ID NO: 87520 - RNA, 1755 nt, Artificial Sequence; identical to SEQ ID NO: 87413
  derived and/or modified sequence opt1 from hemagglutinin__InfluenzaB__ABR15973

SEQ ID NO: 87521 - RNA, 1752 nt, Artificial Sequence
  derived and/or modified sequence opt1 from hemagglutinin__InfluenzaB__ABR15995
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaucaccccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacuacaagacccagaugaagaaccuguacggcgacagcaacccccagaaguucacguccagcgccaacgggaucaccacccacuacgugucccagaucggcggcuuccccaaccagaccgaggacgggggccucccgcagagcgggcgcaucguggucgacuacauggugcagaagcccggcaagacggggaccaucguguaccagcggggcguccugcugccccagaagguguggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggccguccugcucuccaacgagggcaucaucaacagcgaggacgagcaccuccuggcgcuggagcggaagcugaagaagaugcuggggcccuccgccguggacaucggcaacgggugcuucgagaccaagcacaagugcaaccagaccugccucgaccgcaucgccgccggcaccuucaacgcgggggaguucagccugcccaccuucgacucccugaacaucacggccgccagccucaacgacgacggccuggacaaccacaccauccugcuguacuacuccaccgccgccagcucccucgcggugacccugaugaucgccaucuucaucgucuacauggugagccgggacaacguguccugcagcaucugccuguga

SEQ ID NO: 87522 - RNA, 1758 nt, Artificial Sequence
  derived and/or modified sequence opt1 from hemagglutinin__InfluenzaB__ABR16017
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87523 - RNA, 1758 nt, Artificial Sequence; identical to SEQ ID NO: 87522
  derived and/or modified sequence opt1 from hemagglutinin__InfluenzaB__ACA64899

SEQ ID NO: 87524 - RNA, 1758 nt, Artificial Sequence
  derived and/or modified sequence opt1 from hemagglutinin__InfluenzaB__ACA64932
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaucaacaagaccgccaccaacagccucacgaucgaggugccguacaucugcaccgagggggaggaccagaucaccgucuggggcuuccacuccgacaacgagacccagauggcgaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggacaagaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgggacaacgugagcugcagcaucugccuguga

SEQ ID NO: 87525 - RNA, 1758 nt, Artificial Sequence; identical to SEQ ID NO: 87522
  derived and/or modified sequence opt1 from hemagglutinin__InfluenzaB__ACA64943

SEQ ID NO: 87526 - RNA, 1758 nt, Artificial Sequence
  derived and/or modified sequence opt1 from hemagglutinin__InfluenzaB__ACA64954
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccuccagccucacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcagcaucugccuguga

SEQ ID NO: 87527 - RNA, 1758 nt, Artificial Sequence; identical to SEQ ID NO: 87522
  derived and/or modified sequence opt1 from hemagglutinin__InfluenzaB__ACA64965

SEQ ID NO: 87528 - RNA, 1758 nt, Artificial Sequence
  derived and/or modified sequence opt1 from hemagglutinin__InfluenzaB__ACA64998
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugcuucaacugcaccgaccuggacguggcccuggggcgccccaagugcaccggcaacaucccguccgcccgggugagcauccuccacgagguccgccccgugacguccggcugcuuccccaucaugcacgaccggaccaagauccgccagcugcccaaccugcuccggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacagcgacaacgagacccagauggccaagcucuacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccugcucccgcagaaggucuggugcgccuccgggcggagcaaggugaucaagggcagccugccccugaucggggaggccgacugccuccacgagaaguacggcgggcugaacaaguccaagcccuacuacaccggcgagcacgcgaaggccaucggcaacugccccaucugggugaagacgccgcugaagcucgccaacgggaccaaguaccgcccgcccgccaagcugcugaaggagcggggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 87529 - RNA, 1758 nt, Artificial Sequence
  derived and/or modified sequence opt1 from hemagglutinin__InfluenzaB__ACA65020
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaacaacaagaccgccaccaacagccucacgaucgaggugccguacaucugcaccgagggggaggaccagaucaccaucuggggcuuccacuccgacaacgagacccagauggcgaagcuguacggggacagcaagccccagaaguucacguccagcgccaacggcgucaccacccacuacgugucccagaucggcggguuccccaaccagaccgaggacggcgggcugccccagagcggccggaucguggucgacuacauggugcagaaguccgggaagacgggcaccaucaccuaccagcgcggcauccuccugccgcagaagguguggugcgccagcgggcggagcaaggucaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcgguggaggucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcagcaucugccuguga

SEQ ID NO: 87530 - RNA, 1758 nt, Artificial Sequence; identical to SEQ ID NO: 87528
  derived and/or modified sequence opt1 from hemagglutinin__InfluenzaB__ACA65031

SEQ ID NO: 87531 - RNA, 1758 nt, Artificial Sequence
  derived and/or modified sequence opt1 from hemagglutinin__InfluenzaB__ACA65042
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaacaacaagaccgccaccaacagccucacgaucgaggugccguacaucugcaccgagggggaggaccagaucaccgucuggggcuuccacuccgacaacgagacccagauggcgaagcuguacggggacagcaagccccagaaguucacguccagcgccaacggcgugaccacccacuacgugucccagaucggcggguuccccaaccagaccgaggacggcgggcugccccagagcggccggaucaucgucgacuacauggugcagaaguccgggaagacgggcaccaucaccuaccagcgcggcauccuccugccgcagaagguguggugcgccagcgggcggagcaaggucaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgucacgcucaugaucgcgaucuucgugguguacauggucucccgcgacaacgugagcugcagcaucugccuguga

SEQ ID NO: 87532 - RNA, 1758 nt, Artificial Sequence
  derived and/or modified sequence opt1 from hemagglutinin__InfluenzaB__ACA65053
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccggaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87533 - RNA, 1758 nt, Artificial Sequence
  derived and/or modified sequence opt1 from hemagglutinin__InfluenzaB__ACA65075
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucacccuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacgcaggaggccaucaacaagaucaccaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggacguucgacgcgggcgaguucagccuccccaccuucgacucccugaacaucaccgccgccagccugaacgacgacggccucgacaaccacaccauccugcuguacuacuccacggccgccagcucccuggcggucacccucaugaucgccaucuucgugguguacauggucagccgcgacaacguguccugcagcaucugccuguga

SEQ ID NO: 87534 - RNA, 1758 nt, Artificial Sequence; identical to SEQ ID NO: 87522
  derived and/or modified sequence opt1 from hemagglutinin__InfluenzaB__ACA65086

SEQ ID NO: 87535 - RNA, 1758 nt, Artificial Sequence; identical to SEQ ID NO: 87522
  derived and/or modified sequence opt1 from hemagglutinin__InfluenzaB__ACA65097

SEQ ID NO: 87536 - RNA, 1758 nt, Artificial Sequence; identical to SEQ ID NO: 87522
  derived and/or modified sequence opt1 from hemagglutinin__InfluenzaB__ACA96552

SEQ ID NO: 87537 - RNA, 1758 nt, Artificial Sequence; identical to SEQ ID NO: 87522
  derived and/or modified sequence opt1 from hemagglutinin__InfluenzaB__ACA96563

SEQ ID NO: 87538 - RNA, 1758 nt, Artificial Sequence; identical to SEQ ID NO: 87522
  derived and/or modified sequence opt1 from hemagglutinin__InfluenzaB__ACA96574

SEQ ID NO: 87539 - RNA, 1758 nt, Artificial Sequence; identical to SEQ ID NO: 87522
  derived and/or modified sequence opt1 from hemagglutinin__InfluenzaB__ACA96585

SEQ ID NO: 87540 - RNA, 1758 nt, Artificial Sequence
  derived and/or modified sequence opt1 from hemagglutinin__InfluenzaB__ACA96596
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucgacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87541 - RNA, 1758 nt, Artificial Sequence; identical to SEQ ID NO: 87522
  derived and/or modified sequence opt1 from hemagglutinin__InfluenzaB__ACA96607

SEQ ID NO: 87542 - RNA, 1758 nt, Artificial Sequence
  derived and/or modified sequence opt1 from hemagglutinin__InfluenzaB__ACA96618
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucuuccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87543 - RNA, 1758 nt, Artificial Sequence; identical to SEQ ID NO: 87522
  derived and/or modified sequence opt1 from hemagglutinin__InfluenzaB__ACA96629

SEQ ID NO: 87544 - RNA, 1758 nt, Artificial Sequence; identical to SEQ ID NO: 87528
  derived and/or modified sequence opt1 from hemagglutinin__InfluenzaB__ACA96640

SEQ ID NO: 87545 - RNA, 1755 nt, Artificial Sequence
  derived and/or modified sequence opt1 from hemagglutinin__InfluenzaB__ACD56566
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacguggucgacgcggagaacgccccgggcgggcccuaccggcucggcacguccgggagcugccccaacgccaccuccaagagcggcuucuucgccaccauggcgugggccgugcccaaggacaacaacaagaacgccaccaacccgcugacgguggagguccccuacgugugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgcccagaccgaggacgggggccucccgcagagcgggcgcaucguggucgacuacauggugcagaagccccggaagacgggcaccaucguguaccagcgcgggguccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgacaagaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87546 - RNA, 1755 nt, Artificial Sequence
  derived and/or modified sequence opt1 from hemagglutinin__InfluenzaB__ACD56577
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaaggcccagaugaagaaccuguacggcgacagcaacccccagaaguucaccuccagcgccaacggggugacgacccacuacgugucccagaucggcggcuuccccgcgcagaccgaggacgggggccucccgcagagcgggcgcaucgucguggacuacauggugcagaagccccggaagaccggcacgaucgucuaccagcgcggggugcugcugccccagaagguguggugcgccuccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggcgaacggcaccaaguaccggcccccggccaagcuccugaaggagcgcggcuucuucggggccaucgccggcuuccuggagggcgggugggaggggaugaucgccggcuggcacggcuacaccagccacggggcgcacggcgucgccguggccgccgaccucaaguccacccaggaggccaucaacaagaucaccaagaaccugaacagccuguccgagcucgaggugaagaaccugcagcgccugagcggggcgauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcccuggagcgcaagcugaagaagaugcugggccccuccgcgguggacaucgggaacggcugcuucgagacgaagcacaagugcaaccagaccugccucgaccggaucgccgccgggaccuucaacgccggcgaguucagccugcccaccuucgacucccugaacaucaccgccgcgagccucaacgacgacgggcuggacaaccacacgauccugcuguacuacuccaccgccgccagcucccucgccgucacccugaugcuggccaucuucaucguguacauggugagccgcgacaacgucuccugcagcaucugccucuga

SEQ ID NO: 87547 - RNA, 1758 nt, Artificial Sequence; identical to SEQ ID NO: 87528
  derived and/or modified sequence opt1 from hemagglutinin__InfluenzaB__ACF41658

SEQ ID NO: 87548 - RNA, 1758 nt, Artificial Sequence
  derived and/or modified sequence opt1 from hemagglutinin__InfluenzaB__ACF54136
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacaagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacaucuccugcagcaucugccuguga

SEQ ID NO: 87549 - RNA, 1758 nt, Artificial Sequence; identical to SEQ ID NO: 87522
  derived and/or modified sequence opt1 from hemagglutinin__InfluenzaB__ACF54147

SEQ ID NO: 87550 - RNA, 1755 nt, Artificial Sequence
  derived and/or modified sequence opt1 from hemagglutinin__InfluenzaB__ACF54158
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaagucccggcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccucuga

SEQ ID NO: 87551 - RNA, 1755 nt, Artificial Sequence
  derived and/or modified sequence opt1 from hemagglutinin__InfluenzaB__ACF54169
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccccaugaagaaccuguacggcgacagcaacccccagaaguucacguccagcgccaacggggugaccacccacuacgucucccagaucggcggcuucccggcccagaccgaggacgaggggaucccccagagcggccgcaucgugguggacuacaugguccagaagccccggaagacggggaccaucguguaccagcgcggcgugcuccugccccagaaggucuggugcgcguccgggcggagcaaggugaucaagggcagccugccgcucaucggcgaggccgacugccugcacgagaaguacgggggccugaacaaguccaagcccuacuacaccggggagcacgccaaggccaucggcaacugccccaucugggucaagacgccccucaagcuggccaacgggaccaaguaccgcccgcccgcgaagcugcucaaggagcggggcuucuucggcgccaucgccggguuccuggagggcgggugggagggcaugaucgccggguggcacggcuacaccagccacggcgcccacgggguggcgguggccgccgaccugaaguccacccaggaggccaucagcaagaucaccaagaaccucaacucccugagcgagcuggaggucaagaaccuccagcgccuguccggcgccauggacgagcugcacaacgagauccucgagcuggacgagaagguggacgaccugcgggcggacacgaucagcucccagaucgagcucgccgugcugcugagcaacgaggggaucaucaacuccgaggacgagcaccuccuggcccuggagcgcaagcucaagaagaugcugggccccagcgccgucgacaucggcaacgggugcuucgagaccaagcacaagugcaaccagaccugccuggaccggaucgcggccggcaccuucaacgccggggaguucucccuccccaccuucgacagccugaacaucacggccgccucccugaacgacgacggccucgacaaccacaccauccugcuguacuacagcaccgcggccuccagccuggccgugacccucaugcuggccaucuucaucguguacauggucucccgcgacaacgugagcugcagcaucugccuguga

SEQ ID NO: 87552 - RNA, 1755 nt, Artificial Sequence
  derived and/or modified sequence opt1 from hemagglutinin__InfluenzaB__ACF54180
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccccaugaagaaccuguacggcgacagcaacccccagaaguucacguccagcgccaacggggugaccacccacuacgucucccagaucggcggcuucccggcccagaccgaggacgggggccucccccagagcgggcgcaucgugguggacuacaugguccagaagccccggaagacgggcaccaucguguaccagcgcggggugcugcugccccagaaggucuggugcgcguccggccggagcaaggugaucaagggcagccucccgcugaucggggaggccgacugccugcacgagaaguacggcgggcucaacaaguccaagcccuacuacaccggcgagcacgccaaggccaucgggaacugccccaucugggucaagacgccccugaagcuggccaacggcaccaaguaccgcccgcccgcgaagcuccugaaggagcggggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgaggucaagaaccugcagcgccugagcggggccauggacgagcuccacaacgagauccuggagcuggacgagaagguggacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucguguacauggucagccgcgacaacguguccugcagcaucugccucuga

SEQ ID NO: 87553 - RNA, 1755 nt, Artificial Sequence
  derived and/or modified sequence opt1 from hemagglutinin__InfluenzaB__ACF54202
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacgucccgcagcugccccaacgccaccuccaagagcggguucuucgccaccauggcgugggccguccccaaggacaacaacaagaacgccaccaacccgcugacgguggaggugcccuacgucugcaccgagggcgaggaccagaucaccguguggggcuuccacuccgacaacaagacccagaugaagaaccuguacggggacagcaacccccagaaguucacguccagcgccaacggcgugaccacccacuacgucucccagaucgggggcuuccccgcccagaccgaggacgagggccucccgcagagcgggcggaucgugguggacuacaugguccagaagccccgcaagacgggcaccaucguguaccagcgcggggugcugcugccccagaaggucuggugcgcguccggccggagcaaggugaucaaggggagccucccccugaucggcgaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggguucuucggcgccaucgccggcuuccuggagggcgggugggaggggaugaucgccggcuggcacggguacaccagccacggcgcccacggcguggcgguggccgccgaccucaaguccacccaggaggccaucaacaagaucaccaagaaccugaacagccuguccgagcucgaggucaagaaccugcagcggcugagcggggccauggacgagcuccacaacgagauccuggagcuggacgagaagguggacgaccuccgcgcggacacgaucuccagccagaucgagcuggccgugcugcucuccaacgagggcaucaucaacagcgaggacgagcaccuccuggcccuggagcggaagcugaagaagaugcuggggcccuccgccgucgacaucggcaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucguguacauggucagccgggacaacguguccugcagcaucugccucuga

SEQ ID NO: 87554 - RNA, 1755 nt, Artificial Sequence
  derived and/or modified sequence opt1 from hemagglutinin__InfluenzaB__ACF54213
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacgacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgagaacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87555 - RNA, 1758 nt, Artificial Sequence
  derived and/or modified sequence opt1 from hemagglutinin__InfluenzaB__ACF54224
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccagcaacggcgugaccacccacuacgugucccagaucggcggguuccccaaccagaccgaggacggcgggcugccccagagcggccgcaucgucguggacuacauggugcagaaguccgggaagacgggcaccaucaccuaccagcggggcauccuccugccgcagaaggucuggugcgccagcgggcgcagcaaggugaucaagggcucccugccccucaucggggaggccgacugccugcacgagcgguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcagcaucugccuguga

SEQ ID NO: 87556 - RNA, 1755 nt, Artificial Sequence
  derived and/or modified sequence opt1 from hemagglutinin__InfluenzaB__ACF54257
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucgacgccgagaaggccccgggcgggcccuaccgccucggcacguccgggagcugccccaacgccaccuccaagagcggcuucuucgcgaccauggccugggccgugccccgggagaacaacaagaccgccacgaacccgcugaccgucgaggugccccacaucugcaccaaggaggaggaccagaucaccguguggggcuuccacuccgacaacaagccccagaugaagaaccuguacggggacagcaacccccagaaguucacguccagcgccaacggcaucaccacccacuacgucucccagaucgggggcuucccggaccagaccgaggacggcgggcucccccagagcggccgcaucgugguggacuacaugguccagaagcccgggaagacgggcaccaucguguaccagcgggggauccugcugccccagaagguguggugcgcguccggccgcagcaaggucaucaagggcagccucccgcugaucggggaggccgacugccugcacgagaaguacggcgggcucaacaaguccaagcccuacuacaccggcgagcacgccaaggccaucgggaacugccccaucugggugaagacgccccugaagcuggccaacggcaccaaguaccggccgcccgcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgcggacacgaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugaucgccaucuucaucguguacaugaucagccgggacaacguguccugcagcaucugccuguga

SEQ ID NO: 87557 - RNA, 1755 nt, Artificial Sequence
  derived and/or modified sequence opt1 from hemagglutinin__InfluenzaB__ACF54268
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucgacgccgagaaggccccgggcgggcccuaccgccucggcacguccgggagcugccccaacgccaccuccaagagcggcuucuucgcgaccauggccugggccgugccccgggagaacaacaagaccgccacgaacccgcugaccgucgaggugccccacaucugcaccaaggaggaggaccagaucaccguguggggcuuccacuccgacaacaagauccagaugaagaaccuguacggggacagcaacccccagaaguucacguccagcgccaacggcaucaccacccacuacgucucccagaucgggggcuuccccgaccagaccgaggacggcgggcucccgcagagcggccgcaucgugguggacuacaugguccagaagcccgggaagacgggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgcggacacgaucuccagccagaucgagcuggccgugcugcucuccaacgagggcaucaucaacagcgaggacgagcaccuccuggcccuggagcggaagcugaagaagaugcugggccccuccgccaucgacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugaucgccaucuucaucgucuacaugaucagccgggacaacguguccugcagcaucugccuguga

SEQ ID NO: 87558 - RNA, 1755 nt, Artificial Sequence
  derived and/or modified sequence opt1 from hemagglutinin__InfluenzaB__ACF54279
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucgacgccgagaaggccccgggcgggcccuaccgccucggcacguccgggagcugccccaacgccaccuccaagagcggcuucuucgcgaccauggccugggccgugccccgggagaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 87559 - RNA, 1755 nt, Artificial Sequence
  derived and/or modified sequence opt1 from hemagglutinin__InfluenzaB__ACF54290
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacguggucgacgcggagaacgccccgggcgggcccuaccggcucggcacguccgggagcugccccaacgccaccuccaagagcggcuucuucgccaccauggcgugggccgugcccaaggacaacaacaagaacgccaccaacccgcugacgguggagguccccuacgugugcaccgagggcgaggaccagaucaccguguggggguuccacuccgacaagaagacccagaugaagaaccuguacggcgacagcaacccccagaaguucacguccagcgccaacggggucaccacccacuacgugucccagaucggcggcuuccccgcccagaccgaggacgggggccucccgcagagcgggcgcaucguggucgacuacauggugcagaagccccggaagacgggcaccaucguguaccagcgcgggguccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgacaagaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87560 - RNA, 1758 nt, Artificial Sequence
  derived and/or modified sequence opt1 from hemagglutinin__InfluenzaB__ACF54312
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcuccaacggcgugaccacccacuacaucagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccagcgggcgcuccaaggucaucaagggcagccugccccucaucggggaggccgacugccugcacgagaaguacggcgggcugaacaaguccaagcccuacuacaccggcgagcacgccaaggcgaucggcaacugccccaucugggugaagacgccgcucaagcuggccaacgggaccaaguaccggccgcccgccaagcugcucaaggagcgcggcuucuucggggccaucgccggcuuccuggagggcgggugggagggcaugaucgcgggguggcacggcuacaccagccacggggcccacggcguggccgucgccgccgaccugaaguccacccaggaggcgaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcccuggagcggaagcucaagaagaugcugggccccuccgcgaucgagaucgggaacggcugcuucgagaccaagcacaagugcaaccagaccugccuggaccgcaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucgucguguacauggugagccgggacaacgucagcugcuccaucugccuguga

SEQ ID NO: 87561 - RNA, 1758 nt, Artificial Sequence
  derived and/or modified sequence opt1 from hemagglutinin__InfluenzaB__ACF54323
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccggaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgggacaacguguccugcagcaucugccuguga

SEQ ID NO: 87562 - RNA, 1755 nt, Artificial Sequence
  derived and/or modified sequence opt1 from hemagglutinin__InfluenzaB__ACF54345
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaaggcccagaugaagaaccuguacggcgacagcaacccccagaaguucaccuccagcgcgaacggggugacgacccacuacgugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugcgcgagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87563 - RNA, 1755 nt, Artificial Sequence
  derived and/or modified sequence opt1 from hemagglutinin__InfluenzaB__ACF54367
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcuggccaaccuccugcggggguacgagaacauccgccugagcacccagaacgugaucgacgccgagaaggcccccggcgggccguaccggcucggcaccuccgggagcugccccaacgcgacguccaagagcggcuucuucgccaccauggccugggccguccccaaggacaacaacaagaacgccaccaacccccugaccguggaggugccguacaucugcacggagggcgaggaccagaucaccgucuggggguuccacuccgacagcaagacccagaugaagaaccuguacggcgacuccaacccccagaaguucaccagcuccgcgaacggggugacgacccacuacgugagccagaucggcggcuuccccgaccagaccgaggacgggggccucccccaguccgggcgcaucgucguggacuacaugaugcagaagccgggcaagaccgggacgaucguguaccagcggggcguccugcugccccagaagguguggugcgccagcggccgcagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccucccacggcgcgcacgggguggccgucgccgccgaccucaagagcacccaggaggccaucaacaagaucaccaagaaccugaacucccugagcgagcucgaggugaagaaccugcagcggcuguccggcgcgauggacgagcuccacaacgagauccuggagcuggacgagaagguggacgaccuccgcgccgacaccaucagcucccagaucgagcuggccguccugcucagcaacgagggcaucaucaacuccgaggacgagcaccuccuggcccuggagcggaagcugaagaagaugcuggggcccagcgcgguggacaucggcaacgggugcuucgagacgaagcacaagugcaaccagaccugccucgaccgcaucgccgccggcaccuucaacgccggggaguucucccugcccaccuucgacagccugaacaucaccgccgcgucccucaacgacgacggccuggacaaccacacgauccugcuguacuacagcaccgccgccuccagccucgccgugacccugaugcuggccaucuucaucgucuacauggugucccgggacaacgugagcugcagcaucugccucuga

SEQ ID NO: 87564 - RNA, 1755 nt, Artificial Sequence
  derived and/or modified sequence opt1 from hemagglutinin__InfluenzaB__ACN32556
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccuucgccaacggcaucaccacccacuacgucagccagaucgggggcuuccccgaccagacggaggacggcgggcucccgcaguccggccgcaucgugguggacuacaugguccagaagcccgggaagaccggcaccaucguguaccagcgggggauccugcugccccagaagguguggugcgcgagcggccgcuccaaggucaucaagggcagccucccccugaucggggaggccgacugccugcacgagaaguacggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucacgaagaaccugaacucccugagcgagcucgaggugaagaaccugcagcggcuguccggggccauggacgagcuccacaacgagauccuggagcuggacgagaaggucgacgaccuccgcgcggacaccaucagcucccagaucgagcuggccgugcugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgcggccgggaccuucaacgccggcgaguucucccugcccacguucgacagccugaacaucaccgccgccucccucaacgacgacgggcuggacaaccacaccauccugcuguacuacagcaccgcggccuccagccucgccgucacgcugaugaucgccaucuucaucguguacaugaucucccgggacaacgugagcugcuccaucugccuguga

SEQ ID NO: 87565 - RNA, 1758 nt, Artificial Sequence
  derived and/or modified sequence opt1 from hemagglutinin__InfluenzaB__ACN32567
auggaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87566 - RNA, 1758 nt, Artificial Sequence; identical to SEQ ID NO: 87522
  derived and/or modified sequence opt1 from hemagglutinin__InfluenzaB__ACN32578

SEQ ID NO: 87567 - RNA, 1758 nt, Artificial Sequence
  derived and/or modified sequence opt1 from hemagglutinin__InfluenzaB__ACN32589
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaacaacaagaccgccaccaacagccucacgaucgaggugccguacaucugcaccgagggggaggaccagaucaccaucuggggcuuccacuccgacaacgagacccagauggcgaagcuguacggggacagcaagccccagaaguucacguccagcgccaacggcgucaccacccacuacgugucccagaucggcggguuccccaaccagaccgaggacggcgggcugccccagagcggccggaucguggucgacuacauggugcagaaguccgggaagacgggcaccaucaccuaccagcgcggcauccuccugccgcagaagguguggugcgccagcgggcggagcaaggucaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgucacgcucaugaucgcgaucuucgugguguacauggucucccgcgacaacgugagcugcagcaucugccuguga

SEQ ID NO: 87568 - RNA, 1758 nt, Artificial Sequence
  derived and/or modified sequence opt1 from hemagglutinin__InfluenzaB__ACN32600
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaacaacaagaccgccaccaacagccucacgaucgaggugccguacaucugcaccgagggggaggaccagaucaccgucuggggcuuccacuccgacaacgagacccagauggcgaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgcccggcugcucaaggagcgcggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcccuggagcggaagcucaagaagaugcugggccccagcgcggucgagaucgggaacggcugcuucgagaccaagcacaagugcaaccagaccugccuggaccgcaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgggacaacgugagcugcagcaucugccuguga

SEQ ID NO: 87569 - RNA, 1758 nt, Artificial Sequence; identical to SEQ ID NO: 87533
  derived and/or modified sequence opt1 from hemagglutinin__InfluenzaB__ACN32611

SEQ ID NO: 87570 - RNA, 1755 nt, Artificial Sequence; identical to SEQ ID NO: 87434
  derived and/or modified sequence opt1 from hemagglutinin__InfluenzaB__ACN32716

SEQ ID NO: 87571 - RNA, 1758 nt, Artificial Sequence; identical to SEQ ID NO: 87522
  derived and/or modified sequence opt1 from hemagglutinin__InfluenzaB__ACN32771

SEQ ID NO: 87572 - RNA, 1758 nt, Artificial Sequence; identical to SEQ ID NO: 87528
  derived and/or modified sequence opt1 from hemagglutinin__InfluenzaB__ACN32782

SEQ ID NO: 87573 - RNA, 1758 nt, Artificial Sequence
  derived and/or modified sequence opt1 from hemagglutinin__InfluenzaB__ACO05957
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 87574 - RNA, 1755 nt, Artificial Sequence
  derived and/or modified sequence opt1 from hemagglutinin__InfluenzaB__ACO05968
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagcgcgaggaccagaucaccgucuggggcuuccacuccgacaacaagacccagaugaagaaccuguacggggacagcaacccccagaaguucacguccagcgccaacggcgugaccacccacuacgugucccagaucgggagcuuccccgaccagaccgaggacggcggccucccgcaguccgggcggaucgucguggacuacaugaugcagaagcccggcaagacggggaccaucguguaccagcgcggcguccugcugccccagaagguguggugcgccagcgggcggagcaaggugaucaagggcucccucccccugaucggcgaggcggacugccugcacgagaaguacgggggccucaacaagagcaagccguacuacaccggggagcacgccaaggccaucggcaacugccccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccucccacggcgcccacgggguggccgucgcggccgaccucaagagcacccaggaggccaucaacaagaucaccaagaaccugaacucccugagcgagcucgaggugaagaaccugcagcgccuguccggcgccauggacgagcuccacaacgagauccuggagcuggacgagaagguggacgaccuccgggccgacacgaucagcucccagaucgagcuggcgguccugcucagcaacgaggggaucaucaacuccgaggacgagcaccuccuggcccuggagcgcaagcugaagaagaugcugggccccagcgccguggagaucggcaacgggugcuucgagaccaagcacaagugcaaccagaccugccucgaccggaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 87575 - RNA, 1755 nt, Artificial Sequence
  derived and/or modified sequence opt1 from hemagglutinin__InfluenzaB__ACO05979
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgggacaacgugagcugcagcaucugccucuga

SEQ ID NO: 87576 - RNA, 1755 nt, Artificial Sequence; identical to SEQ ID NO: 87575
  derived and/or modified sequence opt1 from hemagglutinin__InfluenzaB__ACO05990

SEQ ID NO: 87577 - RNA, 1758 nt, Artificial Sequence
  derived and/or modified sequence opt1 from hemagglutinin__InfluenzaB__ACO06001
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuucgccaacggcgugacgacccacuacgugucccagaucggcggguuccccaaccagaccgaggacggcgggcugccccagagcggccggaucgucguggacuacauggugcagaaguccgggaagaccggcacgaucaccuaccagcgcggcauccuccugccgcagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcuccaucugccuguga

SEQ ID NO: 87578 - RNA, 1755 nt, Artificial Sequence; identical to SEQ ID NO: 87575
  derived and/or modified sequence opt1 from hemagglutinin__InfluenzaB__ACO06012

SEQ ID NO: 87579 - RNA, 1755 nt, Artificial Sequence; identical to SEQ ID NO: 87575
  derived and/or modified sequence opt1 from hemagglutinin__InfluenzaB__ACO06023

SEQ ID NO: 87580 - RNA, 1755 nt, Artificial Sequence
  derived and/or modified sequence opt1 from hemagglutinin__InfluenzaB__ACO06062
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucgacagcuuccccgaccagaccgaggacggcggccucccgcaguccgggcgcaucgucguggacuacaugaugcagaagcccggcaagacggggaccaucguguaccagcggggcguccugcugccccagaagguguggugcgccagcgggcgcagcaaggugaucaagggcucccucccccugaucggcgaggcggacugccugcacgagaaguacgggggccucaacaagagcaagccguacuacaccggggagcacgccaaggccaucggcaacugccccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgaggggaucaucaacuccgaggacgagcaccuccuggcccuggagcggaagcugaagaagaugcugggccccagcgccguggagaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcagcaucugccucuga

SEQ ID NO: 87581 - RNA, 1758 nt, Artificial Sequence
  derived and/or modified sequence opt1 from hemagglutinin__InfluenzaB__ACO94661
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucaccaccauggccugggccgugcccaagaacgacaacaacaagaccgccacgaacucccucaccaucgaggugccguacaucugcaccgagggggaggaccagaucaccgucuggggcuuccacagcgacaacgagacgcagauggcgaagcuguacggggacuccaagccccagaaguucaccagcuccgccaacggcgugaccacccacuacgugagccagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacgcaggaggcgaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcccuggagcgcaagcucaagaagaugcugggccccuccgcggucgagaucgggaacggcugcuucgagaccaagcacaagugcaaccagaccugccuggaccggaucgccgccgggacguucgacgccggcgaguucagccuccccaccuucgacucccugaacaucaccgcggccagccugaacgacgacggccucgacaaccacaccauccugcuguacuacuccacggccgccagcucccuggccgugacccucaugaucgcgaucuucguggucuacauggugagccgcgacaacguguccugcagcaucugccuguga

SEQ ID NO: 87582 - RNA, 1758 nt, Artificial Sequence; identical to SEQ ID NO: 87522
  derived and/or modified sequence opt1 from hemagglutinin__InfluenzaB__ACR15622

SEQ ID NO: 87583 - RNA, 1758 nt, Artificial Sequence
  derived and/or modified sequence opt1 from hemagglutinin__InfluenzaB__ACR15633
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcagcaucugccuguga

SEQ ID NO: 87584 - RNA, 1755 nt, Artificial Sequence
  derived and/or modified sequence opt1 from hemagglutinin__InfluenzaB__ACR15644
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagauccagaugaagaaccuguacggcgacagcaacccccagaaguucaccuccagcgccaacggggugacgacccacuacgucucccagaucggcggcuuccccgcccagaccgaggacgggggccucccgcagagcgggcgcaucgugguggacuacaugguccagaagccccggaagaccggcacgaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgaggucaagaaccugcagcgccugagcggggccauggacgagcuccacaacgagauccuggagcuggacgagaagguggacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccgucgacaucgggaacggcugcuucgagacgaagcacaagugcaaccagaccugccucgaccggaucgcggccgggaccuucaacgccggcgaguucagccugcccaccuucgacucccugaacaucaccgccgccagccucaacgacgacgggcuggacaaccacacgauccugcuguacuacuccaccgcggccagcucccucgccgugacccugaugcuggccaucuucaucguguacauggucagccgcgacaacguguccugcagcaucugccucuga

SEQ ID NO: 87585 - RNA, 1758 nt, Artificial Sequence
  derived and/or modified sequence opt1 from hemagglutinin__InfluenzaB__ACR15655
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacaucagcugcagcaucugccuguga

SEQ ID NO: 87586 - RNA, 1758 nt, Artificial Sequence
  derived and/or modified sequence opt1 from hemagglutinin__InfluenzaB__ACR15666
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacaaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacgacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87587 - RNA, 1758 nt, Artificial Sequence
  derived and/or modified sequence opt1 from hemagglutinin__InfluenzaB__ACR15677
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgaggcccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccguggagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 87588 - RNA, 1755 nt, Artificial Sequence; identical to SEQ ID NO: 87575
  derived and/or modified sequence opt1 from hemagglutinin__InfluenzaB__ACR15710

SEQ ID NO: 87589 - RNA, 1755 nt, Artificial Sequence
  derived and/or modified sequence opt1 from hemagglutinin__InfluenzaB__ACR15721
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacgacaacaagaccgccacgaacccgcugaccguggaggugcccuacgucugcaccgagggcgaggaccagaucaccguguggggguuccacuccgacaacaaggcccagaugaagaaccuguacggcgacagcaacccccagaaguucacguccagcgccaacggggugaccacccacuacgucucccagaucggcggcuuccccgaccagaccgaggacgggggccucccgcagagcgggcggaucgugguggacuacaugguccagaagcccggcaagacggggaccaucguguaccagcgcggcgugcugcugccccagaaggucuggugcgcguccggccggagcaaggugaucaaggggagccucccccugaucggcgaggccgacugccugcacgagaaguacgggggccucaacaaguccaagccguacuacaccggggagcacgccaaggccaucggcaacugccccaucugggucaagacgccccugaagcuggccaacggcaccaaguaccggcccccggcgaagcuccugaaggagcgcggguucuucggcgccaucgccggguuccuggagggcgggugggagggcaugaucgccggcuggcacggguacaccagccacggcgcccacgggguggcgguggccgccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggcggacacgaucuccagccagaucgagcuggccgugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugaucgccaucuucaucguguacauggucagccgcgacaacguguccugcagcaucugccuguga

SEQ ID NO: 87590 - RNA, 1758 nt, Artificial Sequence
  derived and/or modified sequence opt1 from hemagglutinin__InfluenzaB__ACR39336
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgcgacaacguguccugcagcaucugccuguga

SEQ ID NO: 87591 - RNA, 1755 nt, Artificial Sequence
  derived and/or modified sequence opt1 from hemagglutinin__InfluenzaB__AEA51386
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacuacaagaacgccaccaacccgcugacgguggaggugcccuacaucugcaccgagggcgaggggcagaucaccgucuggggcuuccacuccgacaacaagccccagaugaagaaccuguacggggacagcaacccccagaaguucaccuccagcgccuccggcgugacgacccacuacgugagccagaucggcgacuucccggaccagaccgaggacgggggccucccccaguccgggcgcaucgucguggacuacaugaugcagaagcccggcaagaccgggacgaucguguaccagcggggcguccugcugccccagaagguguggugcgccagcggccgcagcaaggugaucaaggggucccucccgcugaucggcgaggcggacugccugcacgagaaguacgggggccucaacaagagcaagcccuacuacaccggggagcacgccaaggccaucggcaacugccccaucugggucaucacgccccagaagcuggccaacggcaccaccuucuccccgcccgccaagcugcucaaggagcggggguucuucggcgcgaucgccggguuccuggagggcgggugggagggcaugaucgccggcuggcacggguacaccagccacggcgcccacgggguggccgucgcggccgaccugaaguccacccaggaggccaucaacaagaucaccaagaaccucaacagccuguccgagcuggaggugaagaaccuccagcgccugagcggcgccauggacgagcugcacaacgagauccucgagcuggacgagaagguggacgaccugcgggccgacacgaucuccagccagaucgagcucgcgguccugcuguccaacgagggcaucaucaacagcgaggacgagcaccuccuggcccuggagcgcaagcucaagaagaugcuggggcccuccgccguggacaucggcaacgggugcuucgagaccaagcacaagugcaaccagaccugccuggaccggaucgccgcgggcaccuucaacgccggggaguucagccuccccaccuucgacucccugaacaucacggccgccagccugaacgacgacggccucgacaaccacaccauccugcuguacuacuccaccgccgcgagcucccuggccgugacccucaugcuggccaucuucaucgucuacauggugagccgcgacaacgugagcugcuccaucugccuguga

SEQ ID NO: 87592 - RNA, 1755 nt, Artificial Sequence
  derived and/or modified sequence opt1 from hemagglutinin__InfluenzaB__AEA51387
augaaggccaucaucgugcugcucauggucgugaccagcaacgccgaccgcaucugcaccgagaucacguccagcaacuccccgcugguggucaagaccgcgacccagggcgaggugaacgugaccggggucaucccgcugacgaccacccccaccaagagcuacuucgccaaccucaagggcacgcggacccgcgggaagcugugccccgacugccugaacugcaccgaccucgacguggcccugggccggcccaugugcguggggaccacgccguccgccaaggccagcauccugcacgagguccgccccgugaccuccggcugcuuccccaucaugcacgaccggaccaagauccgccagcuccccaaccugcugcggggcuacgagaacauccgccucagcacccagaacgugaucgacgcggagaaggcccccgggggccccuaccggcuggggacguccggcagcugccccaacgccaccuccaagaucggguucuucgccaccauggcgugggccguccccaaggacaacuacaagaacgccaccaacccgcugacgguggaggugcccuacaucugcaccgagggcgaggaccagaucaccgucuggggcuuccacagcgacaacaagacccagaugaagaaccucuacggggacuccaacccccagaaguucacgagcuccgccaacggcgugaccacccacuacgugagccagaucggggacuuccccgaccagaccgaggacggcggccugccgcaguccgggcgcaucgucguggacuacaugaugcagaagcccggcaagacggggcccaucguguaccagcggggcguccugcucccccagaagguguggugcgccagcgggcgcuccaaggugaucaagggcagccugccgcugaucggcgaggcggacugccuccacgagaaguacgggggccugaacaagagcaaguacucccacaccggggaccacgccaagacccugggcaacugccccaucugggucaagacgccccucaagcuggccaacgggaccaaguaccggcccccggccaagcugcucaaggagcgcggcuucuucggcgccaucgcgggguuccuggagggcgggugggagggcaugaucgccggguggcacggcuacaccagccacggcgcccacgggguggccgucgccgcggaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgccgacacgaucuccagccagaucgagcucgccguccugcuguccaacgaggggaucaucaacagcgaggacgagcaccuccuggcgcuggagcggaagcucaagaagaugcugggccccuccgccguggacaucggcaacgggugcuucgagaccaagcacaagugcaaccagaccugccuggaccgcaucgccgccggcaccuucaacgcgggggaguucagccuccccaccuucgacucccugaacaucacggccgccagccugaacgacgacggccuggacaaccacaccauccuccuguacuacuccaccgccgccagcucccuggcggugacccucaugcuggccaucuucaucgucuacauggugagccgggacaacguguccugcagcaucugccuguga

SEQ ID NO: 87593 - RNA, 1755 nt, Artificial Sequence
  derived and/or modified sequence opt1 from hemagglutinin__InfluenzaB__AEA51388
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguccuacaccggcgagcacgccaaggccaaggggaacugccccaucugggucaacacgccccugaagcuggccaacggcaccaaguaccggcccccggccaagcuguucaaggagcgcggcuucuucggggcgaucgccggcuuccucgagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaaggggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgggacaacguguccugcagcaucugccuguga

SEQ ID NO: 87594 - RNA, 1755 nt, Artificial Sequence
  derived and/or modified sequence opt1 from hemagglutinin__InfluenzaB__AEA51389
augaaggccaucaucgugcugcucauggucgugaccagcaacgccgaccgcaucugcaccggcaucacguccagcaucagcccccugguggacaagaccgcgacccagggggaggucaacgugaccggcgugaucccgcugacgaccacccccaccaaguccuacuucgccaacgucaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcgcagaaggccccgggcgggcccuaccggcucggcacguccgggagcugccccaacgccaccuccaagaucggcuucuucgccaccauggcgugcgccguccccaaggacaacuacaagaacgccaccaacccgcugacgguggaggugcccuacauccgcaccgagggcgaggaccagaucaccgucuggggguuccacagcgacaacaagacccagaugaagaaccuguacggcgacuccaacccgcccaaguucacgagcuccgccaacggggugaccacccacuacgugagccagaccggcgacuuccccgaccagacggaggacggcgggcucccgcccuccggccggaucgucguggacuacaugaugcagaagcccgggaagaccggcaccaucgccuaccagcgcggggugcugcugccccagaaggucuggugcgcgagcggccgguccaaggugaucaagggcagccucccccugaucggggaggccgacugccugcacgagaaguacggcgggcucaacaagagcaagccgccccacaccggcgagcacacgaaggccaucgggaacugccccaucugggugaagacgccccugaagcuggccaacggcaccaaguaccgccccuccgccaagcuccugaaggagcggggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggucaagaaccugcagcgccugagcggggccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgccgcggggacguucaacgccggcgaguucuuccugccgaccuucgacagccugaacaucaccgccgccucccucaacgacgacgggcuggacaaccacaccauccugcuguacuacagcacggccgcguccagccucgccgugacccugaugcuggccaucuucaucguguacauggucucccgcgacaacgugagcugcuccaucugccucuga

SEQ ID NO: 87595 - RNA, 1755 nt, Artificial Sequence
  derived and/or modified sequence opt1 from hemagglutinin__InfluenzaB__AEA51390
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcccuccggccgcaucgucguggacuacaugaugcagaagcccgggaagacgggcaccaucguguaccagcgcgggggccugcugccccagaaggucuggugcgccagcggccgguccaaggugaucaaggggagccucccgcugaucggcgaggcggacugccugcacgagaaguacgggggccucaacaagagcaagcccuacuacaccggggagcacgccaaggccaucggcaacugccccaucugggugaagcccccgcugaagcuggccaacggcaccaaguaccggccgcccgccaagcuguucaaggagcgcggguucuucggcgcgcuggccggguuccuggagggcgggugggagggcaugaucgccggcuggcacggguacacgucccacggcgcccacggggucgccguggcggccgaccucaagagcacccaggaggccaucaacaagaucaccaagaaccugaacucccugagcgagcucgaggucaagaaccugcagcggcuguccggcgccauggacgagcuccacaacgagauccuggagcuggacgagaagguggacgaccuccgcgccgacaccaucagcucccagaucgagcuggcggugcugcucagcaacgagggcaucaucaacuccgaggacgagcaccuccuggcccucgagcggaagcugaagaagaugcuggggcccagcgccgucgacaucggcaacgggugcuucgagacgaagcacaagugcaaccagaccugccucgaccgcaucgccgcgggcaccuucaacgccggggaguucucccugcccaccuucgacagccugaacaucaccgccgccucccucaacgacgacggccuggacaaccacacgauccugcuguacuacagcaccgccgcguccagccucgccgugacccugaugcuggccaucuucaucguguacauggucucccgggacaacgugagcugcuccaucugccucuga

SEQ ID NO: 87596 - RNA, 1758 nt, Artificial Sequence
  derived and/or modified sequence opt1 from hemagglutinin__InfluenzaB__AEA51391
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgucaacgagacccagauggccaagcuguacggggacagcaagccccagaaguucacguccagcgccaacggcgugaccacccacuacaucucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgugcccgucgccgccgaccugaaguccacccaggaggcgaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgucacgcucaugaucgcgaucuucgugguguacauggucucccgcgacaacgugagcugcuccaucugccuguga

SEQ ID NO: 87597 - RNA, 1758 nt, Artificial Sequence
  derived and/or modified sequence opt1 from hemagglutinin__InfluenzaB__AEA51392
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcggcaccacccacuacgugucccagaucgggggcuucccgaaccagaccgaggacgggggccugccccagagcgggcggaucguggucgacuacauggugcagaaguccggcaagacgggcaccaucaccuaccagcgcgggauccugcucccccagaagguguggugcgccagcggccgguccaaggucaucaaggggagccugccccugaucggcgaggccgacugccuccacgagaaguacgggggccugaacaagagcaagccguacuacaccggcgagcacgcgaaggccaucgggaacugccccaucugggugaagacgccccugaagcucgccaacggcaccaagaacaucgcccccgccaagcugcugaaggagcgcggguucuucggcgcgaucgccggguuccucgagggcggcugggaggggaugaucgccggcuggcacggguacaccucccacggcgcccacggcguggccgucgcggccgaccugaaguccacccaggaggccaucaacaagaucacgaagaaccugaacucccucagcgagcuggaggugaagaaccugcagcggcucuccggggccauggacgagcugcacaacgagauccuggagcucgacgagaaggucgacgaccugcgcgccgacaccaucagcucccagaucgagcuggcggugcuccugagcaacgagggcaucaucaacuccgaggacgagcaccuccuggcccuggagcggaagcugaagaagaugcucgggccgagcgccguggagaucggcaacgggugcuucgagaccaagcacaagugcaaccagaccugccuggaccgcaucgccgcgggcaccuucgacgccggcgaguucucccugcccacguucgacagccucaacaucaccgccgccucccugaacgacgacgggcuggacaaccacaccauccuccuguacuacagcaccgccgcguccagccuggccgucacgcugaugaucgccaucuucgugguguacauggucucccgggacaacgugagcugcuccaucugccucuga

SEQ ID NO: 87598 - RNA, 1755 nt, Artificial Sequence
  derived and/or modified sequence opt1 from hemagglutinin__InfluenzaB__AEA51395
augaaggccaucaucgugcugcucauggucgugaccagcaacgccgaccgcaucugcaccggcaucacguccagcaacagcccccacguggucaagaccgcgacccugggggaggugaacgugaccggcgucaucccgcugacgaccacccccaccaaguccuacuucgccaaccucaaggggacgcggacccgcggcaagcugugccccgacugccugaacugcaccgaccucgacguggcccuggggcggcccaugugcgugggcaccacgccguccgccaaggccagcauccugcacgagguccgccccgugaccuccggcugcuuccccaucaugcacgaccggaccaagauccgccagcuccccaaccugcugcggggguacgagaacauccgccucagcacccagaacgugaucgacgcggagaaggccccgggcgggcccuaccggcugggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccaguucaccgucuggggguuccacagcgacaacaucacccagcucaagaaccuguucggcgacuccaacccccagcgcuucacgagcuccgccaacggggugaccacccacuacgugagccagaucggcgacuuccccgaccagaccgaggacggcgggcugccgcaguccggccggaucgucguggacuacgugaugcagaagcccgggaagacgggcaccaucgucuaccagcgcggggugcuccugccgcccaaggugugguucgcccggggccgcagcaaggucaucaagggcucccugccccucaucggggaggcggacugcauccacgagaaguacggcgggcugaacaagagcaagcccuacuacaccggcgagcacgccaaggccaucgggaacugccccaucugggugaagacgccccugaagcucgccaacggcaccaaguaccggccgcccgccaagcugcugaaggagcgcggcuucuucggggcgaucgccggcuuccucgagggcgggugggaggggaugaucgccggcuggcacggcuacaccagccacggggcccacggcgucgccguggcggccgaccugaaguccacccaggaggccaucaacaagaucaccaagaaccugaacagccucuccgagcuggaggugaagaaccugcagcggcucagcggggccauggacgagcugcacaacgagauccuggagcucgacgagaaggucgacgaccugcgcgccgacacgaucuccagccagaucgagcuggcggugcuccuguccaacgagggcaucaucaacagcgaggacgagcaccuccuggcccuggagcggaagcugaagaagaugcucggccccuccgccguggacaucgggaacggcugcuucgagaccaagcacaagugcaaccagaccugccuggaccgcaucgccgcggggaccuucaacgccggcgaguucagccugcccaccuucgacucccucaacaucacggccgccagccugaacgacgacgggcuggacaaccacaccauccugcucuacuacuccaccgccgcgagcucccuggccgucacccugaugcucgccaucuucaucguguacauggugagccgggacaacgucuccugcagcaucugccuguga

SEQ ID NO: 87599 - RNA, 1758 nt, Artificial Sequence
  derived and/or modified sequence opt1 from hemagglutinin__InfluenzaB__AEA51398
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaucggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaaguccuacuacaccggcgagcacgcgaaggccaucggcaacugcccgaucugggugaagacgccccugaagcucgccaacgggaccaaguaccgcccgcccgcccaccugagcuacuucugcggcuucuucggggccaucgcgggcuuccuggagggcgggugggagggcaugaucgccggguggaacggcuacaccucccacggggcccacggcgucgccguggucgccgaccucaagagcacccaggaggcgaucaacaagaucacgaagaaccugaacucccugagcgagcucgaggugaagaaccugcagcggcuguccggcgccauggacgagcuccacaacgagauccuggagcuggacgagaagguggacgaccuccgcgccgacaccaucagcucccagaucgagcuggccguccugcucagcaacgaggggaucaucaacuccgaggacgagcaccuccuggcccuggagcggaagcugaagaagaugcugggccccagcgcgguggagaucgggaacggcugcuucgagaccaagcacaagugcaaccagaccugccucgaccgcaucgccgccgggaccuucgacgccggcgaguucucccugcccacguucgacagccugaacaucaccgcggccucccucaacgacgacggccuggacaaccacaccauccugcucuacuacagcaccgccgccuccagccuggccgugacgcugaugaucgcgaucuucgucguguacauggugucccgggacaacgucagcugcagcaucugccuguga

SEQ ID NO: 87600 - RNA, 1758 nt, Artificial Sequence
  derived and/or modified sequence opt1 from hemagglutinin__InfluenzaB__AEA51399
augaaggccaucaucgugcugcucauggucgugaccagcaacgccgaccgcaucugcaccggcaucacggcgucccagagccccaacaucgacaaguccagcacccagggggaggugaacgucaccggcgugaucccgcugaccacgacccccaccaagucccacuucgccaaccugaaggggaccgagacgcggggcaagcucugccccaagugccccaacugcaccgaccuggacguggcccuggggcgcccgaagugcaccggcaagauccccagcgcccgggucuccauccuccacgaggugcgccccgugaccagcggcugcuuccccaucaugcacgaccggacgaagauccgccagcugccgaaccugcuccggggguacgagcacauccgccuguccacccacaacgucaucaacgccgagaacgcgcccggcgggcccuacaagaucggcaccagcggguccugccccaacgugaccaacggcaucggcuucuucgccacgauggccugggccgugccgaagaacgacaagaacaagaccgcgaccaacccccugaccaucgagguccccuacaucugcacggagggggaggaccagaucaccguguggggcuuccacagcgacaacgagacccagauggccaagcucuacggggacuccaagccccagaaguucaccagcuccgccaacggcgugacgacccacuacgucagccagaucggcggguucccgaaccagaccgaggacggcgggcugccccaguccggccggaucgugguggacuacaugguccagaaguccgggaagaccggcacgaucaccuaccagcgcggcauccugcucccccagaagguguggugcgccagcgggcggagcaaggugaucaagggcagccugccccugaucggggaggccgacugccuccacgagaaguacggcgggcugaacaaguccaagagcuacuacaccggcgagcacgcgaaggccaucggcaacugcccgaucugggucaagacgccccugaagcucgccaacgggaccaaguaccgcccgcccgcccaccuguccuacuucugcggcuucuucggggccaucgcgggcuuccuggagggcgggugggagggcaugaucgccggguggaacggcuacaccagccacggggcccacggcguggccguggucgccgaccucaaguccacccaggaggcgaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacacgaucuccagccagaucgagcuggccgugcugcucuccaacgaggggaucaucaacagcgaggacgagcaccuccuggcccuggagcggaagcugaagaagaugcugggccccuccgcgguggagaucgggaacggcugcuucgagaccaagcacaagugcaaccagaccugccucgaccgcaucgccgccgggaccuucgacgccggcgaguucagccugcccaccuucgacucccugaacaucacggcggccagccucaacgacgacggccuggacaaccacaccauccugcucuacuacuccaccgccgccagcucccuggccgucacccugaugaucgcgaucuucgugguguacauggucagccgggacaacgugagcugcuccaucugccuguga

SEQ ID NO: 87601 - RNA, 1758 nt, Artificial Sequence
  derived and/or modified sequence opt1 from hemagglutinin__InfluenzaB__AEG21014
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugcacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaugggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucauggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87602 - RNA, 1755 nt, Artificial Sequence
  derived and/or modified sequence opt1 from hemagglutinin__InfluenzaB__AEG21015
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaacggcuucuucgccaccauggcgugggccguccccaaggacaacuacaagggcgccaccaacccgaagacgguggaggugcccuacaucugcaccgagggggagggccagaucaccgucuggggguuccacagcgacaacaagccccagaugaagaaccuguacggcgacuccaacccccagaaguucaccagcuccgccagcggcgugacgacccacuacgugucccagaucggggacuucccggaccagaccgaggacggcgggcugccccagagcggccgcaucgucguggacuacaugaugcagaagcccgggaagaccggcacgaucguguaccagcggggcguccuccugccccagaagguguggugcgccuccgggcgcagcaaggugaucaagggcagccugccgcucaucggggaggcggacugccugcacgagaaguacggcgggcugaacaaguccaagcccuacuacaccggcgagcacgccaaggccaucggcaacugccccaucugggucaucacgccccagaagcucgccaacgggaccaccuucagcccgcccgccaagcugcugaaggagcggggcuucuucggggcgaucgccggcuuccucgagggcgggugggagggcaugaucgccggguggcacggcuacaccucccacggggcccacggcguggccgucgcggccgaccugaaguccacccaggaggccaucaacaagaucaccaagaaccugaacucccucagcgagcuggaggugaagaaccugcagcgccucuccggcgccauggacgagcugcacaacgagauccuggagcucgacgagaagguggacgaccugcgggccgacacgaucagcucccagaucgagcuggcgguccuccugagcaacgaggggaucaucaacuccgaggacgagcaccuccuggcccuggagcgcaagcugaagaagaugcucggccccagcgccguggacaucgggaacggcugcuucgagaccaagcacaagugcaaccagaccugccuggaccggaucgccgcggggaccuucaacgccggcgaguucucccugcccaccuucgacagccucaacaucacggccgccucccugaacgacgacggccuggacaaccacaccauccuccuguacuacagcaccgccgcguccagccuggccgugacccugaugcucgccaucuucaucgucuacauggugucccgcgacaacgugagcugcagcaucugccuguga

SEQ ID NO: 87603 - RNA, 1755 nt, Artificial Sequence
  derived and/or modified sequence opt1 from hemagglutinin__InfluenzaB__AEG21016
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagcgcgccaccaacccgaagacgguggaggugcccuacaucugcaccgagggcgaggaccagaucaccgucuggggguuccacagcgacaacaagccccagaugaagaaccccuacggcgacuccaacccgcagaaguucaccagcuccgccagcggggugacgacccacuacgugucccagaucggcgacuuccccgaccagaccgaggacggcgggcugccccagagcggccggaucgucguggacuacaugaugcagaagcccgggaagaccggcacgaucguguaccagcgcgggguccugcucccgcagaagguguggugcgccuccggccggagcaaggugaucaagggcagccugccccugaucggggaggcggacugccuccacgagaaguacggcgggcugaacaaguccaagcccuacuacaccggcgagcacgccaaggccaucgggaacugccccaucugggucaagaccccgcugaagcucgccaacggcaccaaguaccgcccgcccgccaagcugcugaaggagcggggcuucuucggggcgaucgccggcuuccucgagggcgggugggaggggaugaucgccggcuggcacggcuacacgagccacggggcccacggcguggccgucgcggccgaccugaaguccacccaggaggccaucaacaagaucaccaagaaccugaacagccucuccgagcuggaggugaagaaccugcagcgccucagcggggccauggacgagcugcacaacgagauccuggagcucgacgagaagguggacgaccugcgggccgacaccaucuccagccagaucgagcuggcgguccuccuguccaacgagggcaucaucaacagcgaggacgagcaccuccuggcccuggagcgcaagcugaagaagaugcucggccccuccgccguggacaucgggaacggcugcuucgagacgaagcacaagugcaaccagaccugccuggaccggaucgccgcggggaccuucaacgccggcgaguucagccugcccaccuucgacucccucaacaucaccgccgccagccugaacgacgacgggcuggacaaccacacgauccuccuguacuacuccaccgccgcgagcucccuggccgugacccugaugcucgccaucuucaucgucuacauggugagccgcgacaacguguccugcagcaucugccuguga

SEQ ID NO: 87604 - RNA, 1755 nt, Artificial Sequence
  derived and/or modified sequence opt1 from hemagglutinin__InfluenzaB__AEG21017
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguccuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87605 - RNA, 1755 nt, Artificial Sequence
  derived and/or modified sequence opt1 from hemagglutinin__InfluenzaB__AEG21018
augaaggccaucaucgugcugcucauggucgugaccagcaacgccgaccgcaucugcaccggcaucacguccagcaucagcccccugguggacaagaccgcgacccagggggaggucaacgugaccggcgugaucccgcugacgaccacccccaccaagagcuacuucgccaacgucaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcgcagaaggccccgggcgggcccuaccggcucggcacguccgggagcugccccaacgccaccuccaagaucggcuucuucgccaccauggcgugcgccguccccaaggacaacuacaagaacgccaccaacccgcugacgguggaggugcccuacauccgcaccgagggcgaggaccagaucaccgucuggggguuccacagcgacaacaagacccagaugaagaaccuguacggcgacuccaacccgcccaaguucacgagcuccgccaacggggugaccacccacuacgugagccagaccggcgacuuccccgaccagacggaggacggcgggcucccgcccuccggccggaucgucguggacuacaugaugcagaagcccgggaagaccggccccaucgccuaccagcgcggggugcugcugccccagaaggucuggugcgcgagcggccgguccaaggugaucaagggcagccucccccugaucggggaggccgacugccugcacgagaaguacggcgggcucaacaagagcaaguacucccacaccggcgaccacgccaagacccuggggaacugccccaucugggugaagacgccgcugaagcucgccaacggcaccaaguaccgccccagcgccaagcugcugaaggagcggggcuucuucggggcgaucgccggcuuccucgagggcgggugggaggggaugaucgccggcuggcacggcuacaccucccacggggcccacggcgucgccguggcggccgaccugaaguccacccaggaggccaucaacaagaucacgaagaaccugaacucccucagcgagcuggaggucaagaaccugcagcgccucuccggggccauggacgagcugcacaacgagauccuggagcucgacgagaagguggacgaccugcgggccgacaccaucagcucccagaucgagcuggcggugcuccugagcaacgagggcaucaucaacuccgaggacgagcaccuccuggcccuggagcgcaagcugaagaagaugcucggccccagcgccgucgacaucgggaacggcugcuucgagaccaagcacaagugcaaccagaccugccuggaccggaucgccgcggggaccuucaacgccggcgaguucucccugcccacguucgacagccucaacaucaccgccgccucccugaacgacgacgggcuggacaaccacaccauccugcucuacuacagcaccgccgcguccagccuggccgugacgcugaugcucgccaucuucaucguguacauggucucccgcgacaacgugagcugcagcaucugccuguga

SEQ ID NO: 87606 - RNA, 1755 nt, Artificial Sequence
  derived and/or modified sequence opt1 from hemagglutinin__InfluenzaB__AEG21019
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaccggcgacuuccccgaccagacggaggacggcgggcucccgcccuccggccgcaucgucguggacuacaugaugcagaagcccgggaagaccggcaccaucguguaccagcgcgggguccugcugccccagaagguguggugcgccagcggccgguccaaggugaucaagggcagccucccgcugaucggggaggcggacugccugcacgagaaguacggcgggcucaacaagagcaagcccuccuacaccggcgagcacgccaaggccaucgggaacugccccaucugggucaagacgccccugaagcuggccaacggcaccaaguaccggccgagcgccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucacgaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugcuggccaucuucaucgucuacauggugucccgggacaacgugagcugcagcaucugccucuga

SEQ ID NO: 87607 - RNA, 1758 nt, Artificial Sequence
  derived and/or modified sequence opt1 from hemagglutinin__InfluenzaB__AEG21021
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccauccugcacgaccggaccaagauccgccagcuccccaaccugcugcggggguacgagcacauccgccucagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcuguccaucgaggugcccuacaucugcacggagggggaggaccagaucaccguguggggcuuccacagcgacaacgagacccagauggccaagcuguacggggacuccaagccccagaaguucaccagcuccgccaacggcgucgccacgcacuacgugagccagaucggcggguuccccaaccagaccgaggacggcgggcucccgcaguccggccggaucguggucgacuacauggugcagaaguccgggaagaccggcaccaucacguaccagcgcggcauccugcugccccagaagguguggugcgccuccgggcggagcaaggucaucaagggcagccucccccuguucggggaggcggacugccugcacgagaaguacggcggguucaacaaguccaagcccuacuacaccggcgagcacgccaaggccaucggcaacugcccgaucugggugaagacgccccucaagcuggccaacgggaccaaguaccgcccgcccgccaagcuguucaaggagcggggcuucuucggggcgaucgccggcuuccucgagggcgggugggagggcaugaucgccggguggcacggcuacaccagccacggggcccacggcguggccgucgcggccgaccugaaguccacccaggaggccaucaacaagaucaccaagaaccugaacagccucuccgagcuggaggugaagaaccugcagcgccucagcggcgccauggacgagcugcacaacgagauccuggagcucgacgagaaggucgacgaccugcgggccgacaccaucuccagccagaucgagcuggcggugcuccuguccaacgaggggaucaucaacagcgaggacgagcaccuccuggcccuggagcgcaagcugaagaagaugcucggccccuccgccguggagaucgggaacggcugcuucgagacgaagcacaagugcaaccagaccugccuggaccggaucgccgcggggaccuucgacgccggcgaguucagccugcccaccuucgacucccucaacaucaccgccgccagccugaacgacgacggccuggacaaccacacgauccuccuguacuacuccaccgccgcgagcucccuggccgucacccugaugaucgccaucuucgugguguacauggucagccgcgacaacguguccugcagcaucugccucuga

SEQ ID NO: 87608 - RNA, 1758 nt, Artificial Sequence
  derived and/or modified sequence opt1 from hemagglutinin__InfluenzaB__AEG21022
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcacgaccccguccgcccgggccagcauccugcacgaggugcgccccgucaccuccggcugcuuccccauccugcacgaccggaccaagauccgccagcuccccaaccugcugcggggguacgagcacauccgccucagcacgcacaacgugaucaacgcggagaacgccccgggcgggcccuacaagaucggcaccuccgggagcugccccaacaucaccaacggcaacggcuucuucgccaccauggccugggcggugcccaagaacgacaagaacaagacggccaccaacccgcuguccgucgaggugcccuacaucugcaccgagggggaggaccagaucaccguguggggcuuccacagcgacaacgagacgcagauggccaagcuguacggggacuccaagccccagaaguucaccagcuccgccaacggcgucgccacccacuacgugagccagaucggcggguuccccaaccagaccgaggacggcgggcucccgcaguccggccggaucguggucgacuacauggugcagaaguccgggaagacgggcaccaucaccuaccagcgcggcauccugcugccccagcggggguggugcgcguccggccgcagcaaggugaucaaggggagccucccccuguucggcgaggccgacugccugcacgagaaguacgggggccucaacaaguccaagcccuacuacaccggcgagcacgccaaggccaucgggaacugcccgaucugggucaagacgccccugaagcuggccaacggcaccaaguaccggccgcccgcgaagcuguucaaggagcgcggguucuucggcgccaucgccggguuccucgagggcggcugggaggggaugaucgccggcuggcacggguacaccagccacggcgcccacggcgugcccguggcggccgaccugaaguccacccaggaggccaucaacaagaucacgaagaaccucaacagccuguccgagcuggaggucaagaaccuccagcggcugagcggggccauggacgagcugcacaacgagauccucgagcuggacgagaagguggacgaccugcgcgccgacaccaucuccagccagaucgagcucgcgguccugcuguccaacgagggcaucaucaacagcgaggacgagcaccuccuggcccuggagcggaagcucaagaagaugcuggggcccuccgccguggagaucggcaacgggugcuucgagaccaagcacaagugcaaccagaccugccuggaccgcaucgccgcgggcaccuucgacgccggcgaguucagccuccccacguucgacucccugaacaucaccgccgccagccugaacgacgacgggcucgacaaccacaccauccugcuguacuacuccaccgccgcgagcucccuggccgugacgcucaugaucgccaucuucgucguguacauggugagccgggacaacgucuccugcagcaucugccuguga

SEQ ID NO: 87609 - RNA, 1755 nt, Artificial Sequence
  derived and/or modified sequence opt1 from hemagglutinin__InfluenzaB__AEG21023
augaaggccaucaucgugcugcucauggucgugaccagcaacgccgaccgcaucugcaccggcaucacguccagcaacagcccccacguggucaagaccgcgacccugggggaggugaacgagaccggcgugaucccgcugacgaccacccccaccaaguccuacuucgccaaccucaaggggacgcggacccgcggcaagcugugccccgacugccugaacugcaccgaccucgacgucgcccuggggcggcccaugugcgugggcaccacgccguccgccaaggccagcauccugcacgaggugcgccccgucaccuccggcugcuuccccaucaugcacgaccggaccaagauccgccagcuccccaaccugcugcggggguacgagaacauccgccucagcacccagaacgugaucgacgcggagaaggccccgggcgggcccuaccggcugggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacaacaagacccagaugaagaaccucuacggcgacuccaacccccagaaguucacgagcuccgccaacgggguccccacccacuacgugagccagaucggcgacuucccggaccccaccgaggacggcgggcugccccaguccggccgcaucgggguggacuacaugaugcagaagcccggcaagaccgggacgaucgucuaccagcggggcgugcugcucccgcagaagguguggugcgccagcggccgcuccaaggucaucaaggggagccugccccugaucggcgaggcggacugccuccacgagaaguacgggggccugaacaagagcaagcccuacuacaccggggagcacgccaaggccaucggcaacugccccaucugggugaagaccccgcugaagcucgccaacggcaccaaguaccggccgcccgccaagcugcugaaggagcgcggguucuucggcgcgaucuccggguuccucgagggcgggugggagggcaugaucgccggcuggcacggguacacgagccacggcgcccacgggguggccgucgccgcggaccugaaguccacccaggaggccaucaacaagaucaccaagaaccugaacagccucuccgagcuggaggugaagaaccugcagcggcucagcggcgccauggacgagcugcacaacgagauccuggagcucgacgagaaggucgacgaccugcgcgccgacaccaucuccagccagaucgagcuggccgugcuccuguccaacgagggcaucaucaacagcgaggacgagcaccuccuggcgcuggagcggaagcugaagaagaugcucgggcccuccgccguggagaucggcaacgggugcuucgagacgaagcacaagugcaaccagaccugcagcgaccgcaucgccgccggcaccuucgacgcgggggaguucucccugcccaccuucgacagccugaacaucaccgccgccucccucaacgacgacggccuggacaaccacacgauccugcuguacuacagcaccgccgccuccagccucgcggucacccugaugaucgccaucuucgugguguacauggucucccgggacaacgugagcugcagcaucugccuguga

SEQ ID NO: 87610 - RNA, 1758 nt, Artificial Sequence
  derived and/or modified sequence opt1 from hemagglutinin__InfluenzaB__AEG21024
augaaggccaucaucgugcugcucauggucgugaccagcaacgccgaccgcaucugcaccggcaucacguccagcuccagcccccacguggucaagaccgcgacccagggggaggugaacgugaccggcgucaucccgcugacgaccacccccaccaaguccuacuucgccaaccugaaggggacggagacccggggcaagcucugccccgacugccccaacugcaccgaccuggacguggcccuggggcgcccgaacugcuggggcaacauccccagcgcccggguguccauccuccacgagguccgccccgugaccagcggcugcuuccccaucaugcacgaccggacgaagauccgccagcugccgaaccugcuccggggguacgagcacauccgccuguccacccacaacgugaucaacgccgagaacgcgcccggcgggcccuacaagaucggcaccagcggguccugccccaacgucaccaacggcaacggcuucuucgccacgauggccugggccgugccgaaggacgacaagaacaacgcggccacccaccuccugaccaucgaggugcccuucuucugcaccgggggcgagcaccacaucgccgucuggggguuccccagcgacaacgacacgcugauggccaagcuguucggcgacuccaacccccagauguucagcuccagcgccaacggcaccaccacccacuacgugucccagaucgggggcuucccgaaccagacggaggacgggggccucccccagagcgggcggaucguggucgacuacauggugcagaaguccggcaagaccggcaccaucgcguaccagcgcggggugcugcugccccagaaggucuggugcgccagcggccggagcaaggugaucaaggggucccucccccugaucggcgaggccgacugccugcacgagaaguacgggggccucaacaagagcaagccguacuacaccggcgagcacgccaaggccaucgggaacugccccaucugggugaagacgccccugaagcuggcgaacggcaccaaguaccggcccccggccaagcuccugaaggagcgcggguucuucggcgccaucgccggguuccuggagggcggcugggaggggaugaucgccggcuggcacggguacaccucccacggcgcgcacggcgucgccguggccgccgaccucaagagcacccaggaggccaucaacaagaucacgaagaaccugaacucccugagcgagcucgaggucaagaaccugcagcgccuguccggggcgauggacgagcuccacaacgagauccuggagcuggacgagaagguggacgaccuccgggccgacaccaucagcucccagaucgagcuggccgugcugcucagcaacgagggcaucaucaacuccgaggacgagcaccuccuggcccuggagcgcaagcugaagaagaugcuggggcccagcgcggucgagaucggcaacgggugcuucgagaccaagcacaagugcaaccagaccugccucgaccggaucgccgccggcacguucgacgccggcgaguucucccugcccaccuucgacagccugaacaucaccgccgcgucccucaacgacgacgggcuggacaaccacaccauccugcuguacuacagcaccgccgccuccagccucgccgugacgcugaugaucgccaucuucguggucuacauggugucccgcgacaacgugagcugcagcaucugccuguga

SEQ ID NO: 87611 - RNA, 1755 nt, Artificial Sequence
  derived and/or modified sequence opt1 from hemagglutinin__InfluenzaB__AEG21025
augaaggccaucaucgugcugcucauggucgugaccagcaacgccgaccgcaucugcaccggcaucacguccagcaacagcccccacguggucaagaccgcgacccugggggaggugaacgagaccggcgugaucccgcugacgaccacccccaccaaguccuacuucgccaaccucaaggggacgcggacccgcggcaagcugugccccgacugccugaacugcaccgaccucgacgucgcccuggggcggcccaugugcgugggcaccacgccguccgccaaggccagcauccugcacgaggugcgccccgucaccuccggcugcuuccccaucaugcacgaccggaccaagauccgccagcuccccaaccugcugcggggguacgagaacauccgccucagcacccagaacgugaucgacgcggagaaggccccgggcgggcccuaccggcugggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacaucaagacccagaugaagaaccucuacggcgacuccaacccccagaaguucacgagcuccgccaacgggguccccacccacuacgugagccagaucggcgacuucccggaccccaccgaggacggcgggcugccccaguccggccgcaucgggguggacuacaugaugcagaagcccggcaagaccgggacgaucgucuaccagcggggcgugcugcucccgcagaagguguggugcgccagcggccgcuccaaggucaucaaggggagccugccccugaucggcgaggcggacugccuccacgagaaguacgggggccugaacaagagcaagcccuacuacaccggggagcacgccaaggccaucggcaacugccccaucugggugaagaccccgcugaagcucgccaacggcaccaaguaccggccgcccgccaagcugcugaaggagcgcggguucuucggcgcgaucuccggguuccucgagggcgggugggagggcaugaucgccggcuggcacggguacacgagccacggcgcccacgggguggccgucgccgcggaccugaaguccacccaggaggccaucaacaagaucaccaagaaccugaacagccucuccgagcuggaggugaagaaccugcagcggcucagcggcgccauggacgagcugcacaacgagauccuggagcucgacgagaaggucgacgaccugcgcgccgacaccaucuccagccagaucgagcuggccgugcuccuguccaacgagggcaucaucaacagcgaggacgagcaccuccuggcgcuggagcggaagcugaagaagaugcucgggcccuccgccguggagaucggcaacgggugcuucgagacgaagcacaagugcaaccagaccugcagcgaccgcaucgccgccggcaccuucgacgcgggggaguucucccugcccaccuucgacagccugaacaucaccgccgccucccucaacgacgacggccuggacaaccacacgauccugcuguacuacagcaccgccgccuccagccucgcggucacccugaugaucgccaucuucgugguguacauggucucccgggacaacgugagcugcagcaucugccuguga

SEQ ID NO: 87612 - RNA, 1758 nt, Artificial Sequence
  derived and/or modified sequence opt1 from hemagglutinin__InfluenzaB__AEG21026
augaaggccaugauggugcugcucauggucgugaccagcaacgccgaccgcaucugcaccggcaucacguccagcaacagcccccacguggucaagaccgcgacccagggggaggugaacgugaccggcgucaucccgcugacgaucacccccaccaagagccacuucgccaaccugaaggugaaggagacccgggggaagcucugccccaagugccccaacugcacggaccuggacguggcccugggccgcccgaagugcaccgggaagauccccuccgcccgggucagcauccuccacgaggacacccccgugaccuccggcugcauccccaucaugcacgaccgcacgaagauccggcagcugccgaaccugcuccgcggcuacgagcacauccggcugagcacccacaacgugaucaacgccgaguccgcgcccgggggccccuacaagaucgggaccagcggcuccugccccaacgucaccaacgggaucggcuucuucgccacgauggccugggccgugccgaagaacgacaagaacaagaccgcgaccaacccccugaccaucgaggugcccuacaucugcacggagggcgaggaccagaucaccgucuggggguuccacuucgacaacgagacccagauggccaagcucuacggcgacagcaagccccagguguucaccuccagcgccaacggggugaacgccgacuucgucucccagauccgcggcuucccgaaccagacggaggacggcgggcugccccagagcggccggaucgugguggacuacaugguccagaaguccgggaagaccggcaccaucaccuaccagcgcgggauccugcucccccagaagguguggugcgccagcggccgguccaaggugaucaaggagagccugccccugaucggcgaggcguacuuccagcaggaggaguacgggggccucaacaagagcaaguccuacuacacggaggagcacgccaaggccaucgggaucugcccgaucugggucaagacgccccugaagcuggccaacaagaccaaguaccgcccgcccgcccaccucagcuacuucugcggcuucuucggggcgaucgccggcuuccuggagggcgggugggagggcaugaucgccggguggaacggcuacaccucccacggggcccacggcguggccgucguggcggaccugaaguccacccaggaggccaucaacaagaucaccaagaaccucaacucccugagcgagcuggagguggagacccuccagcggcuguccggcgccauggacgagcugcacaacgagauccucgagcuggacgagaaggucgacgaccaccgcgccgacaccaucagcucccagaucgagcugcccgaccagcucagcaacgacggguccaucaacagcgaggacgagcaccuccuggcccuggagcggaagcugaagaagaugcugggccccuccaacggggacaagggcagcggcgggaucgagacgaagcacaagugcaaccagaccugccucgaccgcaucgcggccggcaccuucgacgccgggggcuucucccaccccaccuucgacagcaagaacgugaccgccgcgucccugaacgacgacgggcuggacagcggcacgauccuccuguacuacuccaccgacgugagcaaccuggccgucaccgugaugaugggcaucuucgugaaguacauggucagccgggacaacguguccugcagcaucugccucuga

SEQ ID NO: 87613 - RNA, 1758 nt, Artificial Sequence
  derived and/or modified sequence opt1 from hemagglutinin__InfluenzaB__AEG21027
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaucacccccaccaagagccacuucgccaaccugaaggggaccgagacgcggggcaagcucugccccaagugccccaacugcaccgaccuggacguggcccuggggcgcccgaagugcaccggcaagauccccuccgcccgggugagcauccuccacgagguccgccccgugaccuccggcugcuuccccaucaugcacgaccggacgaagauccgccagcugccgaaccugcuccggggguacgagcacauccgccugagcacccacaacgugaucaacgccgagaacgcgcccggcgggcccuacaagaucggcaccuccgggagcugccccaacgucaccaacggcaucggcuucuucgccacgauggccugggccgugccgaagaacgacaagaacaagaccgcgaccaacccccugaccaucgaggugcccuacaucugcacggagggggaggaccagaucaccgucuggggcuuccacuucgacaacgagacccagauggccaagcucuacggggacuccaagccccagaaguucaccagcuccgccaacggcgugaacgccgacuucgugagccagaucggcggguucccgaaccagacggaggacggcgggcugccccaguccggccggaucgucguggacuacauggugcagaaguccgggaagaccggcaccaucaccuaccagcgcggcauccugcucccccagaaggucuggugcgccuccgggcggagcaaggugaucaaggagucccugccccugaucggcgaggcguacuuccagcaggaggaguacgggggccucaacaagagcaagagcuacuacacgggggagcacgccaaggccaucggcaacugcccgaucugggugaagacgccccugaagcuggccaacggcaccaaguaccgcccgcccgcccaccucuccuacuucugcggguucuucggcgcgaucgccggguuccuggagggcgggugggagggcaugaucgccggcuggaacggguacaccagccacggcgcccacggggucgccguggucgcggaccugaaguccacccaggaggccaucaacaagaucaccaagaaccucaacagccuguccgagcuggagguggagacccuccagcggcugagcggcgccauggacgagcugcacaacgagauccucgagaucgacgagaagguggacgaccaccgcgccgacaccaucuccagccagaucgagcuggccguccugcucuccaacgagggcaucaucaacagcgaggacgagcaccuccuggcgcuggagcggaagcugaagaagaugcuggggcccuccaacggcgacaaggggagcggcgggaucgagacgaagcacaagugcaaccagaccugccucgaccgcaucgccgccggcaccuucgacgccggcgaguucucccugcccaccuucgacagccugaacaucaccgcggccucccucaacgacgacgggcuggacagcggcacgauccugcucuacuacuccaccgacgugagcaaccuggccgugaccgucaugauggggaucuucgugaaguacauggugucccgggacaacgucagcugcagcaucugccuguga

SEQ ID NO: 87614 - RNA, 1758 nt, Artificial Sequence
  derived and/or modified sequence opt1 from hemagglutinin__InfluenzaB__AEG21028
augaaggccaucaucgugcugcucauggucgugaccagcaacgccgaccgcaucugcaccggcaucacggcgucccagagccccaacaucgacaaguccagcacccagggggaggugaacgucuccugcgugaucccgcugaccaccacgcccaccaagagccacuucgccaaccugaaggugaaggagacccggggcaagcucugccccaagugccccaacugcaccgaccuggacgucucccuggggcgcccgaagugcacgggcaagauccccagcgcccggguguccauccuccacgaggugcgccccgucgccagcgggggcuuccccaucaugcacgaccggaccaagauccgccagcugccgaaccugcuccggggcuacgagcacauccgccuguccacccacaacgugaucaacgccgagaacgcgcccgggggccccuacaagaucgggaccagcggcuccugccccaacgugacgaacgggaucggcuucuucgccaccauggccugggccgucccgaagaacgacaagaacaagaccgcgaccaacccccugacgaucgaggugcccuacaucugcaccgagggcgaggaccagaucaccguguggggguuccacagcgacaacgagacccagauggccaagcucuacggcgacuccaagccccagaaguucacgagcuccgccaacggggucaccacccacuacgccgccaagcggccgugcuuccccaaccagaccgaggacggcggccugccccagagcgggcgcaucgugguggacuacaugguccagaaguccggcaagacggggaccaucaccuaccagcggggcauccugcucccccagaagguguggugcgcgagcgggcgcagcaaggugaucaagggcucccugccgcugaucggcgaggccgacugccuccacgagaaguacgggggccugaacaagagcaaguccuacuacaccggggagcacgccaaggccaucggcaacugccccaucugggucaagacgccccugaagcucgccagccggaccauguccaagacccccgcgcaccugagcuacuucugcggguucuucggcgccaucgccggcuuccuggagggcgggugggaggggaugaucgccggcuggaacggguacaccucccacggcgcccacggcguggcgguggucgccgaccucaagagcacgcaggaggccaucaacaagaucaccaagaaccugaacucccugagcgagcucgaggugaagaaccugcagcgccuguccggggccauggacgagcuccacaacgagauccuggagcuggacgagaaggucgacgaccuccgggccgacaccaucagcucccagaucgagcuggcggugcugcucagcaacgagggcaucaucaacuccgaggacgagcaccuccuggcccuggagcgcaagcugaagaagaugcuggggccgagcgccguggagaucggcaacggcugcuucgagaccaagcacaagugcaaccagacgugccucgaccggaucgccgcggggaccuucgacgccggcgaguucucccugcccaccuucgacagccugaacaucaccgccgccucccucaacgacgacgggcuggacaaccacaccauccugcucuacuacagcacggccgcgagcucccuggccgucacccugaugaucgccaucuucgugguguacauggucagccgcgacaacguguccugcagcaucugccuguga

SEQ ID NO: 87615 - RNA, 1758 nt, Artificial Sequence
  derived and/or modified sequence opt1 from hemagglutinin__InfluenzaB__AEG21029
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaucggcuucuucgccaccauggccugggccgugccgaagaacgacaagaacaagaccgcgaccaacccccugacgaucgaggugcccuacaucugcaccgagggggaggaccagaucaccgucuggggcuuccacuccgacagcgagacccagauggccaagcucuacggggacuccaagccccagaaguucacgagcuccgccaacggcgugaccacccacuacgugagccagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccacgagaaguacggcgggcugaacaaguccaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 87616 - RNA, 1758 nt, Artificial Sequence
  derived and/or modified sequence opt1 from hemagglutinin__InfluenzaB__AEO80052
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 87617 - RNA, 1758 nt, Artificial Sequence; identical to SEQ ID NO: 87522
  derived and/or modified sequence opt1 from hemagglutinin__InfluenzaB__AEO80067

SEQ ID NO: 87618 - RNA, 1755 nt, Artificial Sequence
  derived and/or modified sequence opt1 from hemagglutinin__InfluenzaB__AEO80078
augaaggagaucaucgugcugcucauggucgugaccagcaacgccgaccgcaucugcaccggcaucacguccagcaacagcccccacguggucaagaccgccacccagggggaggugaacgugaccggcgucaucccgcugacgaccacccccaccaaguccuacuucgcgaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggccaaccuccugcggggguacgagaacauccgccugagcacccagaacgugaucgacgcggagaaggcccccggcgggccguaccggcucggcacguccgggagcugccccaacgccaccuccaagagcggcuucuucgccaccauggcgugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87619 - RNA, 1758 nt, Artificial Sequence
  derived and/or modified sequence opt1 from hemagglutinin__InfluenzaB__AEO80086
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 87620 - RNA, 1755 nt, Artificial Sequence
  derived and/or modified sequence opt1 from hemagglutinin__InfluenzaB__AEO80097
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87621 - RNA, 1755 nt, Artificial Sequence; identical to SEQ ID NO: 87434
  derived and/or modified sequence opt1 from hemagglutinin__InfluenzaB__AEO80108

SEQ ID NO: 87622 - RNA, 1758 nt, Artificial Sequence; identical to SEQ ID NO: 87522
  derived and/or modified sequence opt1 from hemagglutinin__InfluenzaB__AEO80145

SEQ ID NO: 87623 - RNA, 1758 nt, Artificial Sequence; identical to SEQ ID NO: 87581
  derived and/or modified sequence opt1 from hemagglutinin__InfluenzaB__AEO80154

SEQ ID NO: 87624 - RNA, 1758 nt, Artificial Sequence
  derived and/or modified sequence opt1 from hemagglutinin__InfluenzaB__AEO80183
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaucgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87625 - RNA, 1758 nt, Artificial Sequence
  derived and/or modified sequence opt1 from hemagglutinin__InfluenzaB__AEO80194
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgcccgggggcgcuccaaggugaucaagggcagccugccccucaucggggaggcggacugccugcacgagaaguacggcgggcugaacaagagcaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccucccacggggcccacggcgucgccguggcggccgaccucaagagcacccaggaggccaucaacaagaucaccaagaaccugaacucccugagcgagcuggaggucaagaaccuccagcggcuguccggcgccauggacgagcugcacaacgagauccucgagcuggacgagaagguggacgaccugcgcgccgacacgaucagcucccagaucgagcucgcggugcugcugagcaacgaggggaucaucaacuccgaggacgagcaccuccuggcccuggagcggaagcucaagaagaugcugggccccagcgccgucgagaucgggaacggcugcuucgagaccaagcacaagugcaaccagaccugccuggaccgcaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucguggucuacaugaucucccgggacaacgugagcugcuccaucugccuguga

SEQ ID NO: 87626 - RNA, 1758 nt, Artificial Sequence; identical to SEQ ID NO: 87573
  derived and/or modified sequence opt1 from hemagglutinin__InfluenzaB__AEO80205

SEQ ID NO: 87627 - RNA, 1758 nt, Artificial Sequence; identical to SEQ ID NO: 87573
  derived and/or modified sequence opt1 from hemagglutinin__InfluenzaB__AEO80216

SEQ ID NO: 87628 - RNA, 1755 nt, Artificial Sequence
  derived and/or modified sequence opt1 from hemagglutinin__InfluenzaB__AEO80227
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagauccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 87629 - RNA, 1758 nt, Artificial Sequence; identical to SEQ ID NO: 87590
  derived and/or modified sequence opt1 from hemagglutinin__InfluenzaB__AEO80238

SEQ ID NO: 87630 - RNA, 1758 nt, Artificial Sequence
  derived and/or modified sequence opt1 from hemagglutinin__InfluenzaB__AEP20178
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccugaacugcaccgaccuggacguggcccucgggcgccccaagugcaccggcaacaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgacaacaacaagaccgccaccaacagccucacgaucgaggugccguacaucugcaccgagggggaggaccagaucaccgucuggggcuuccacuccgacaacgagacccagauggcgaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcagcaucugccuguga

SEQ ID NO: 87631 - RNA, 1758 nt, Artificial Sequence
  derived and/or modified sequence opt1 from hemagglutinin__InfluenzaB__AEP20189
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccgugcugcuguacuacuccaccgccgccagcucccuggcggugacgcucaugaucgccaucuucgucguguacauggugagccgcgacaacgucuccugcagcaucugccuguga

SEQ ID NO: 87632 - RNA, 1758 nt, Artificial Sequence; identical to SEQ ID NO: 87522
  derived and/or modified sequence opt1 from hemagglutinin__InfluenzaB__AEP20200

SEQ ID NO: 87633 - RNA, 1755 nt, Artificial Sequence; identical to SEQ ID NO: 87413
  derived and/or modified sequence opt1 from hemagglutinin__InfluenzaB__AEP20211

SEQ ID NO: 87634 - RNA, 1755 nt, Artificial Sequence
  derived and/or modified sequence opt1 from hemagglutinin__InfluenzaB__AEP20222
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagccacuucgccaaccugaaggggacgaagacccggggcaagcucugcccgaccugcuucaacugcaccgaccuggacgucgcccuggggcgccccaugugcgugggcaucacgcccuccgccaaggcgagcauccuccacgaggugcggcccgucaccuccggcugcuuccccaucaugcacgaccgcaccaagauccggcagcugcccaaccugcuccgcggguacgagaagauccggcugagcacccagaacgugaucgacgccgagaaggccccgggcgggcccuaccgccugggcacguccgggagcugccccaacgccaccuccaagagcggcuucuucgcgaccauggccugggccgugccccgggacaacaacaagaccgccacgaacccgcucaccgucgaggugcccaacaucugcaccaaggaggaggaccagaucaccguguggggcuuccacuccgacaacaagacgcagaugaagaaccuguacggggaccccaacccccagaaguucaccagcuccgccaacggcaucaccacccacuacgucagccagaucgggggcuucccggaccagacggaggacggcgggcugccccaguccggccgcaucgugguggacuacaugguccagaagcccgggaagaccggcaccaucguguaccagcgggggauccuccugccccagaagguguggugcgcgagcggccgcuccaaggucaucaagggcagccugccgcucaucggggaggccgacugccugcacgagaaguacggcgggcugaacaagagcaagcccuacuacaccggcgagcacgccaaggccaucgggaacugccccaucugggugaagacgccccucaagcuggccaacggcaccaaguaccggccgcccgcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucacgaagaaccucaacucccugagcgagcuggaggugaagaaccuccagcggcuguccggggccauggacgagcugcacaacgagauccucgagcuggacgagaaggucgacgaccugcgcgcggacaccaucagcucccagaucgagcucgccgugcugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgcggccgggaccuucaacgccggcgaguucucccuccccacguucgacagccugaacaucaccgccgccucccugaacgacgacgggcucgacaaccacaccauccugcuguacuacagcaccgcggccuccagccuggccgucacgcucaugaucgccaucuucaucguguacaugaucucccgggacaacgugagcugcuccaucugccuguga

SEQ ID NO: 87635 - RNA, 1755 nt, Artificial Sequence; identical to SEQ ID NO: 87519
  derived and/or modified sequence opt1 from hemagglutinin__InfluenzaB__AEP20233

SEQ ID NO: 87636 - RNA, 1755 nt, Artificial Sequence
  derived and/or modified sequence opt1 from hemagglutinin__InfluenzaB__AEP20244
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugcuucaacugcaccgaccuggacgucgcccuggggcgccccaugugcaugggcaucacgcccuccgccaaggcgagcauccuccacgaggugcggcccgugaccuccggcugcuuccccaucaugcacgaccgcaccaagauccggcagcugcccaaccugcuccgcggguacgagaagauccggcugagcacccagaacgucaucgacgccgagaaggccccgggcgggcccuaccgccugggcacguccgggagcugccccaacgccaccuccaagagcggcuucuucgcgaccauggccugggccgugccccggggcaacaacaagaccgccacgaacccgcucaccguggaggucccccacaucugcaccaaggaggaggaccagaucaccguguggggguuccacuccgacaacaagacgcagaugaagaaccuguacggcgacagcaacccccagaaguucaccuccagcgccaacgggaucaccacccacuacgugucccagaucggcggcuuccccgaccagacggaggacgggggccugccgcagagcgggcgcaucgucguggacuacauggugcagaagcccggcaagaccgggaccaucgucuaccagcggggcauccuccugccccagaagguguggugcgcguccggccgcagcaaggugaucaaggggagccugccccucaucggcgaggccgacugccugcacgagaaguacgggggccugaacaaguccaagccguacuacaccggggagcacgccaaggccaucggcaacugccccaucugggucaagacgccccucaagcuggccaacggcaccaaguaccggcccccggcgaagcugcucaaggagcgcggguucuucggcgccaucgccggguuccuggagggcgggugggagggcaugaucgccggcuggcacggguacaccagccacggcgcccacgggguggcgguggccgccgaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgcggacaccaucuccagccagaucgagcucgccguccugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgcggccggcaccuucaacgccggggaguucagccuccccacguucgacucccugaacaucaccgccgccagccugaacgacgacggccucgacaaccacaccauccugcuguacuacuccaccgcggccagcucccuggccgugacgcucaugaucgccaucuucaucgucuacaugaucagccgggacaacguguccugcagcaucugccuguga

SEQ ID NO: 87637 - RNA, 1758 nt, Artificial Sequence; identical to SEQ ID NO: 87427
  derived and/or modified sequence opt1 from hemagglutinin__InfluenzaB__AEP20255

SEQ ID NO: 87638 - RNA, 1758 nt, Artificial Sequence
  derived and/or modified sequence opt1 from hemagglutinin__InfluenzaB__AEP20277
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggacaagaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87639 - RNA, 1755 nt, Artificial Sequence
  derived and/or modified sequence opt1 from hemagglutinin__InfluenzaB__AEP20299
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaagaacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 87640 - RNA, 1755 nt, Artificial Sequence
  derived and/or modified sequence opt1 from hemagglutinin__InfluenzaB__AEP20310
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccgcccacuacgugucccagaucggcggcuuccccgaccagaccgaggacgggggccucccgcagagcgggcgcaucgucguggacuacaugaugcagaagcccggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagccguacuacaccggggagcacgccaaggccaucggcaacugccccaucugggucaagacgccccugaagcuggccaacggcaccaaguaccggcccccggcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 87641 - RNA, 1758 nt, Artificial Sequence
  derived and/or modified sequence opt1 from hemagglutinin__InfluenzaB__AEP20332
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccgcaucgucguggacuacauggugcagaaguccgggaagacgggcaccaucaccuaccagcggggcauccuccugccccagaaggucuggugcgccagcgggcgcuccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 87642 - RNA, 1755 nt, Artificial Sequence; identical to SEQ ID NO: 87434
  derived and/or modified sequence opt1 from hemagglutinin__InfluenzaB__AEP20343

SEQ ID NO: 87643 - RNA, 1755 nt, Artificial Sequence; identical to SEQ ID NO: 87434
  derived and/or modified sequence opt1 from hemagglutinin__InfluenzaB__AEP20354

SEQ ID NO: 87644 - RNA, 1755 nt, Artificial Sequence; identical to SEQ ID NO: 87434
  derived and/or modified sequence opt1 from hemagglutinin__InfluenzaB__AEP20365

SEQ ID NO: 87645 - RNA, 1755 nt, Artificial Sequence; identical to SEQ ID NO: 87434
  derived and/or modified sequence opt1 from hemagglutinin__InfluenzaB__AEP20376

SEQ ID NO: 87646 - RNA, 1758 nt, Artificial Sequence
  derived and/or modified sequence opt1 from hemagglutinin__InfluenzaB__AEP20398
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 87647 - RNA, 1758 nt, Artificial Sequence; identical to SEQ ID NO: 87616
  derived and/or modified sequence opt1 from hemagglutinin__InfluenzaB__AEP20409

SEQ ID NO: 87648 - RNA, 1758 nt, Artificial Sequence; identical to SEQ ID NO: 87616
  derived and/or modified sequence opt1 from hemagglutinin__InfluenzaB__AEP20420

SEQ ID NO: 87649 - RNA, 1758 nt, Artificial Sequence; identical to SEQ ID NO: 87616
  derived and/or modified sequence opt1 from hemagglutinin__InfluenzaB__AEP20431

SEQ ID NO: 87650 - RNA, 1758 nt, Artificial Sequence; identical to SEQ ID NO: 87616
  derived and/or modified sequence opt1 from hemagglutinin__InfluenzaB__AEP20442

SEQ ID NO: 87651 - RNA, 1758 nt, Artificial Sequence; identical to SEQ ID NO: 87616
  derived and/or modified sequence opt1 from hemagglutinin__InfluenzaB__AEP20453

SEQ ID NO: 87652 - RNA, 1755 nt, Artificial Sequence; identical to SEQ ID NO: 87434
  derived and/or modified sequence opt1 from hemagglutinin__InfluenzaB__AEQ39027

SEQ ID NO: 87653 - RNA, 1758 nt, Artificial Sequence
  derived and/or modified sequence opt1 from hemagglutinin__InfluenzaB__AEQ39260
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87654 - RNA, 1758 nt, Artificial Sequence; identical to SEQ ID NO: 87653
  derived and/or modified sequence opt1 from hemagglutinin__InfluenzaB__AEQ39271

SEQ ID NO: 87655 - RNA, 1758 nt, Artificial Sequence
  derived and/or modified sequence opt1 from hemagglutinin__InfluenzaB__AEQ39282
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacggcgacgagcucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87656 - RNA, 1758 nt, Artificial Sequence
  derived and/or modified sequence opt1 from hemagglutinin__InfluenzaB__AEQ39315
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacggcgacgggcucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87657 - RNA, 1758 nt, Artificial Sequence; identical to SEQ ID NO: 87656
  derived and/or modified sequence opt1 from hemagglutinin__InfluenzaB__AEQ39326

SEQ ID NO: 87658 - RNA, 1758 nt, Artificial Sequence
  derived and/or modified sequence opt1 from hemagglutinin__InfluenzaB__AEQ39337
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccggcaacgcgcccgggggccccuacaagaucgggaccuccggcagcugccccaacgucacgaacggcaacggguucuucgccaccauggccugggccgugcccaagaacgacaagaacaagaccgcgaccaacccgcucacgaucgaggugcccuacaucugcaccgagggcgaggaccagaucaccgucuggggguuccacuccgacaacgagacccagauggccaagcuguacggcgacagcaagccccagaaguucacguccagcgccaacggcgugaccacccacuacgugucccagaucgggggcuuccccaaccagaccgaggacgggggccugccgcagagcgggcggaucgucguggacuacauggugcagaaguccggcaagacgggcaccaucaccuaccagcgcgggauccuccugccccagaaggucuggugcgccagcggccgguccaaggugaucaaggggagccugccccucaucggcgaggccgacugccugcacgagaaguacgggggccugaacaagagcaagcccuacuacaccggcgagcacgcgaaggccaucgggaacugcccgaucugggugaagaagccccucaagcuggccaacggcacgaaguaccgcccgcccgccaagcugcucaaggagcggggguucuucggcgccaucgcgggguuccuggagggcggcugggaggggaugaucgccggcuggcacggguacaccucccacggcgcccacggcgucgccguggccgcggaccugaaguccacccaggaggccaucaacaagaucaccaagaaccucaacucccugagcgagcuggaggucaagaaccuccagcgccuguccggggccauggacgagcugcacaacgagauccucgagcuggacgagaagguggacgaccugcgggccgacacgaucagcucccagaucgagcucgccgugcugcugagcaacgagggcaucaucaacuccgaggacgagcaccuccuggcgcuggagcgcaagcucaagaagaugcuggggccgagcgccgucgagaucggcaacgggugcuucgagaccaagcacaagugcaaccagaccugccuggaccggaucgccgccggcaccuucgacgcgggcgaguucucccuccccaccuucgacagccugaacaucacggccgccucccugaacgacgacgggcucgacaaccacaccauccugcuguacuacagcaccgccgccuccagccuggcggugacccucaugaucgccaucuucguggucuacauggugucccgcgacaacgugagcugcuccaucugccuguga

SEQ ID NO: 87659 - RNA, 1758 nt, Artificial Sequence
  derived and/or modified sequence opt1 from hemagglutinin__InfluenzaB__AEQ39348
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaucauccugcuguacuacagcaccgccgccuccagccuggcggugacccucaugaucgccaucuucguggucuacauggugucccgcgacaacgugagcugcuccaucugccuguga

SEQ ID NO: 87660 - RNA, 1758 nt, Artificial Sequence; identical to SEQ ID NO: 87656
  derived and/or modified sequence opt1 from hemagglutinin__InfluenzaB__AEQ39359

SEQ ID NO: 87661 - RNA, 1758 nt, Artificial Sequence
  derived and/or modified sequence opt1 from hemagglutinin__InfluenzaB__AEQ39370
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacguggucaacgccgagaacgcgccgggcgggcccuacaagaucggcaccuccgggagcugccccaacgugacgaacggcaacggcuucuucgccaccauggccugggccgugcccaagaacgacaacaacaagaccgcgaccaacucccucacgaucgaggucccguacaucugcaccgagggggaggaccagaucaccguguggggcuuccacagcgacaacgagacccagauggccaagcuguacggggacuccaagccccagaaguucacgagcuccgccaacggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgcgacaacgucuccugcagcaucugccuguga

SEQ ID NO: 87662 - RNA, 1755 nt, Artificial Sequence; identical to SEQ ID NO: 87434
  derived and/or modified sequence opt1 from hemagglutinin__InfluenzaB__AEQ39392

SEQ ID NO: 87663 - RNA, 1755 nt, Artificial Sequence; identical to SEQ ID NO: 87434
  derived and/or modified sequence opt1 from hemagglutinin__InfluenzaB__AEQ39429

SEQ ID NO: 87664 - RNA, 1755 nt, Artificial Sequence; identical to SEQ ID NO: 87434
  derived and/or modified sequence opt1 from hemagglutinin__InfluenzaB__AEQ39440

SEQ ID NO: 87665 - RNA, 1755 nt, Artificial Sequence; identical to SEQ ID NO: 87434
  derived and/or modified sequence opt1 from hemagglutinin__InfluenzaB__AEQ39451

SEQ ID NO: 87666 - RNA, 1758 nt, Artificial Sequence; identical to SEQ ID NO: 87646
  derived and/or modified sequence opt1 from hemagglutinin__InfluenzaB__AEQ39462

SEQ ID NO: 87667 - RNA, 1758 nt, Artificial Sequence; identical to SEQ ID NO: 87653
  derived and/or modified sequence opt1 from hemagglutinin__InfluenzaB__AEQ39484

SEQ ID NO: 87668 - RNA, 1755 nt, Artificial Sequence; identical to SEQ ID NO: 87413
  derived and/or modified sequence opt1 from hemagglutinin__InfluenzaB__AEQ39506

SEQ ID NO: 87669 - RNA, 1758 nt, Artificial Sequence
  derived and/or modified sequence opt1 from hemagglutinin__InfluenzaB__AEQ39517
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacaacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 87670 - RNA, 1758 nt, Artificial Sequence
  derived and/or modified sequence opt1 from hemagglutinin__InfluenzaB__AER27038
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccaagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcaucgccgucgccgcggaccugaaguccacccaggaggccaucaacaagaucacgaagaaccugaacucccucagcgagcuggaggugaagaaccugcagcgccucuccggcgccauggacgagcugcacaacgagauccuggagcucgacgagaaggucgacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggucacgcugaugaucgccaucuucgugguguacauggucucccgcgacaacgugagcugcuccaucugccucuga

SEQ ID NO: 87671 - RNA, 1758 nt, Artificial Sequence; identical to SEQ ID NO: 87616
  derived and/or modified sequence opt1 from hemagglutinin__InfluenzaB__AER27060

SEQ ID NO: 87672 - RNA, 1758 nt, Artificial Sequence
  derived and/or modified sequence opt1 from hemagglutinin__InfluenzaB__AET10061
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccaagaacgcgccgggcgggcccuacaagaucggcaccuccgggagcugccccaacgucacgaacggcaacggcuucuucgccaccauggccugggccgugcccaagaacgacaagaaccggaccgcgaccaacucccucacgaucgaggugccguacaucugcaaggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 87673 - RNA, 1755 nt, Artificial Sequence
  derived and/or modified sequence opt1 from hemagglutinin__InfluenzaB__AET10062
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaucacccccaccaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcugaccguggaggugcccuacaucugcaaggagggcgaggaccagaucacggucuggggguuccacagcgacaacaagacccagaugaagaaccuguacggcgacuccaacccccagaaguucaccagcuccgccaacggggugaccacgcacuacgugagccagaucggcgacuuccccgaccagaccgaggacggcgggcucccgcaguccggccgcaucgucguggacuacaugaugcagaagcccgggaagaccggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacacgggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagacgugccucgaccgcaucgccgcggggaccuucaacgccggcgaguucucccugcccaccuucgacagccugaacaucaccgccgccucccucaacgacgacgggcuggacaaccacaccauccugcuguacuacagcacggccgcguccagccucgccgugacccugaugcuggccaucuucaucgucuacauggugucccgggacaacgugagcugcuccaucugccucuga

SEQ ID NO: 87674 - RNA, 1755 nt, Artificial Sequence
  derived and/or modified sequence opt1 from hemagglutinin__InfluenzaB__AET10064
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccaucuggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcucccgcaguccggccgcaucguggucgacuacaugaugcagaagcccgggaagacgggcaccaucguguaccagcgcggggugcugcugccccagaaggucuggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcuccaucugccucuga

SEQ ID NO: 87675 - RNA, 1755 nt, Artificial Sequence
  derived and/or modified sequence opt1 from hemagglutinin__InfluenzaB__AET10065
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaaggagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 87676 - RNA, 1755 nt, Artificial Sequence; identical to SEQ ID NO: 87675
  derived and/or modified sequence opt1 from hemagglutinin__InfluenzaB__AET10066

SEQ ID NO: 87677 - RNA, 1755 nt, Artificial Sequence
  derived and/or modified sequence opt1 from hemagglutinin__InfluenzaB__AET10067
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacggccacccccaccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgccacguccaagaucggcuucuucgcgaccauggccugggccguccccaaggacaacuacaagaacgccaccaacccgcugaccguggaggugcccuacaucugcaaggagggcgaggaccagaucacggucuggggguuccacagcgacaacaagacccagaugaagaaccuguacggcgacuccaacccccagaaguucaccagcuccgccaacggggugaccacgcacuacgugagccagaucggcgacuuccccgaccagaccgaggacggcgggcucccgcaguccggccgcaucgucguggacuacaugaugcagaagcccgggaagaccggcaccaucguguaccagcgcgggguccugcugccccagaagguguggugcgcgagcggccgguccaaggugaucaagggcagccucccccugaucggggaggccgacugccugcacgagaaguacggcgggcucaacaagagcaagccguacuacacgggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagacgugccucgaccgcaucgcggccgggaccuucaacgccggcgaguucucccugcccaccuucgacagccugaacaucaccgccgccucccucaacgacgacgggcuggacaaccacaccauccugcuguacuacagcacggcggccuccagccucgccgugacccugaugcuggccaucuucaucgucuacauggugucccgggacaacgugagcugcuccaucugccucuga

SEQ ID NO: 87678 - RNA, 1755 nt, Artificial Sequence
  derived and/or modified sequence opt1 from hemagglutinin__InfluenzaB__AET10068
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaaguccuacuucgccaaccugaaggggacccggacgcgcggcaagcucugccccgacugccugaacugcaccgaccuggacguggcccucgggcggcccaugugcgccggcaccaccccguccgcgaaggccagcauccugcacgaggugcgccccgucacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgcgacguccaagaucggcuucuucgccaccauggccugggccgugcccaaggacaacuacaagaacgccaccaacccgcugaccgucgaggugcccuacaucugcaaggagggcgaggaccagaucacgguguggggguuccacagcgacaacaagacccagaugaagaaccuguacggcgacuccaacccccagaaguucaccagcuccgcgaacggggucaccacgcacuacgugagccagaucggcgacuuccccgaccagaccgaggacggcgggcucccgcaguccggccgcaucguggucgacuacaugaugcagaagcccgggaagaccggcaccaucguguaccagcgcggggugcugcugccccagaaggucuggugcgccagcggccgguccaaggugaucaagggcagccucccccugaucggggaggccgacugccugcacgagaaguacggcgggcucaacaagagcaagccguacuacacgggcgagcacgccaaggccaucgggaacugccccaucugggugaagacgccccugaagcuggcgaacggcaccaaguaccggcccccggccaagcuccugaaggagcgcggcuucuucggggccaucgccggcuuccuggagggcgggugggaggggaugaucgccggcuggcacggcuacaccucccacggggcgcacggcgucgccguggccgccgaccucaagagcacccaggaggccaucaacaagaucaccaagaaccugaacucccugagcgagcucgaggucaagaaccugcagcggcuguccggggcgauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcccuggagcggaagcugaagaagaugcugggccccagcgcggucgacaucgggaacggcugcuucgagaccaagcacaagugcaaccagacgugccucgaccgcaucgccgccgggaccuucaacgccggcgaguucucccugcccaccuucgacagccugaacaucaccgccgcgucccucaacgacgacgggcuggacaaccacaccauccugcuguacuacagcacggccgccuccagccucgccgugacccugaugcuggccaucuucaucguguacauggucucccgggacaacgugagcugcuccaucugccucuga

SEQ ID NO: 87679 - RNA, 1755 nt, Artificial Sequence; identical to SEQ ID NO: 87675
  derived and/or modified sequence opt1 from hemagglutinin__InfluenzaB__AET10069

SEQ ID NO: 87680 - RNA, 1758 nt, Artificial Sequence
  derived and/or modified sequence opt1 from hemagglutinin__InfluenzaB__AET10070
augaaggccaucaucgugcugcucauggucgugaccagcaacgccgaccgcaucugcaccggcaucacguccagcaacagcccccacguggucaagaccgcgacccagggggaggugaaggugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 87681 - RNA, 1758 nt, Artificial Sequence; identical to SEQ ID NO: 87616
  derived and/or modified sequence opt1 from hemagglutinin__InfluenzaB__AET10071

SEQ ID NO: 87682 - RNA, 1758 nt, Artificial Sequence; identical to SEQ ID NO: 87616
  derived and/or modified sequence opt1 from hemagglutinin__InfluenzaB__AET10072

SEQ ID NO: 87683 - RNA, 1755 nt, Artificial Sequence
  derived and/or modified sequence opt1 from hemagglutinin__InfluenzaB__AET10073
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcgggggugcgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaaggagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 87684 - RNA, 1758 nt, Artificial Sequence
  derived and/or modified sequence opt1 from hemagglutinin__InfluenzaB__AET10074
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccacccggagccacuucgccaaccugaaggggacggagacccgcggcaagcucugccccaagugccccaacugcaccgaccuggacguggcccuggggcggccgaagugcaccggcaagauccccuccgcccgcgugagcauccuccacgagguccggcccgugacguccggcugcuuccccaucaugcacgaccgcaccaagauccggcagcugccgaaccugcuccgcggguacgagcacauccggcugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccgcaucgucguggacuacauggugcagaaguccgggcggacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccuggacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 87685 - RNA, 1758 nt, Artificial Sequence; identical to SEQ ID NO: 87616
  derived and/or modified sequence opt1 from hemagglutinin__InfluenzaB__AET10076

SEQ ID NO: 87686 - RNA, 1758 nt, Artificial Sequence; identical to SEQ ID NO: 87616
  derived and/or modified sequence opt1 from hemagglutinin__InfluenzaB__AET10077

SEQ ID NO: 87687 - RNA, 1758 nt, Artificial Sequence
  derived and/or modified sequence opt1 from hemagglutinin__InfluenzaB__AET10078
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcguccugcacgaggugcgccccgugacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacgugacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucaacgcgggcgaguucucccuccccacguucgacagccugaacaucaccgccgccucccugaacgaggacggccucgacaaccacgccauccugcuguacuacagcaccgccgcguccagccuggccgugacccucaugaucgccaucuucgucguguacauggugucccgcgacaacgucagcugcuccaucugccuguga

SEQ ID NO: 87688 - RNA, 1758 nt, Artificial Sequence
  derived and/or modified sequence opt1 from hemagglutinin__InfluenzaB__AET10079
augaaggccaucaucgugcugcucauggucgugaccagcaacgccgacggcaucugcaccgggaucacguccagcaacagcccccacguggucaagaccgcgacccagggcgaggugaacgugaccggggucaucccgcugacgaccacccccaccaagagccacuucgccaaccugaagggcacggagacccgcgggaagcucugccccaagugccccaacugcaccgaccuggacguggcccugggccggccgaagugcaccggcaagauccccuccgcccgcgugagcauccuccacgagguccggcccgugacguccgggugcuuccccaucaugcacgaccgcaccaagauccggcagcugccgaaccugcuccgcggcuacgagcacauccggcugagcacccacaacgugaucaacgccgagaacgcgcccgggggccccuacaagaucgggaccuccggcagcugccccaacgucacgaacggcaacggguucuucaccaccauggccugggccgugccgaagaacgacaagaacaagaccgccacgaacccccugaccaucgaggugcccuacaucugcaccgagggcgaggaccagaucaccgucuggggguuccacuccgacaacgagacgcagauggcgaagcucuacggcgacagcaagccccagaaguucaccuccagcgccaacggcgugaccacccacuacgugucccagaucgggggcuucccgaaccagacggaggacgggggccugccccagagcgggcgcaucgucguggacuacauggugcagaaguccggcaagaccggcaccaucaccuaccagcgggggauccugcucccccagaaggucuggugcgccagcggccgcuccaaggugaucaaggggagccugccccugaucggcgaggccgacugccuccacgagaaguacgggggccugaacaagagcaagccguacuacacgggcgagcacgccaaggcgaucgggaacugccccaucugggugaagacgccccugaagcucgccaacggcaccaaguaccggcccccggccaagcugcugaaggagcgcggguucuucggcgccaucgccggguuccucgagggcggcugggaggggaugaucgcgggcuggcacggguacaccucccacggcgcccacggcgucgccguggccgccgaccugaaguccacccaggaggcgaucaacaagaucaccaagaaccugaacucccucagcgagcuggaggucgagaaccugcagcggcucuccggggccauggacgagcugcacaacgagauccuggagcucgacgagaagguggacgaccugcgcgccgacaccaucagcucccagaucgagcuggccgugcuccugagcaacgagggcaucaucaacuccgaggacgagcaccuccuggcccuggagcggaagcugaagaagaugcucgggcccagcgcggucgagaucggcaacgggugcuucgagaccaagcacaagugcaaccagaccugccuggaccgcaucgccgccggcacguucgacgccggcgaguucucccugcccaccuucgacagccucaacaucaccgcggccucccugaacgacgacgggcuggacaaccacaccauccuccuguacuacagcacggccgccuccagccuggccgugacccugaugaucgcgaucuucguggucuacauggugucccgggacaacgugagcugcuccaucugccucuga

SEQ ID NO: 87689 - RNA, 1758 nt, Artificial Sequence; identical to SEQ ID NO: 87616
  derived and/or modified sequence opt1 from hemagglutinin__InfluenzaB__AET10080

SEQ ID NO: 87690 - RNA, 1758 nt, Artificial Sequence; identical to SEQ ID NO: 87616
  derived and/or modified sequence opt1 from hemagglutinin__InfluenzaB__AET10081

SEQ ID NO: 87691 - RNA, 1758 nt, Artificial Sequence
  derived and/or modified sequence opt1 from hemagglutinin__InfluenzaB__AET10082
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 87692 - RNA, 1758 nt, Artificial Sequence
  derived and/or modified sequence opt1 from hemagglutinin__InfluenzaB__AET10083
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaaggugccguccgcccgggucagcauccugcacgaggugcgccccgugacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87693 - RNA, 1758 nt, Artificial Sequence; identical to SEQ ID NO: 87653
  derived and/or modified sequence opt1 from hemagglutinin__InfluenzaB__AET10084

SEQ ID NO: 87694 - RNA, 1758 nt, Artificial Sequence; identical to SEQ ID NO: 87616
  derived and/or modified sequence opt1 from hemagglutinin__InfluenzaB__AET10085

SEQ ID NO: 87695 - RNA, 1758 nt, Artificial Sequence; identical to SEQ ID NO: 87656
  derived and/or modified sequence opt1 from hemagglutinin__InfluenzaB__AET43124

SEQ ID NO: 87696 - RNA, 1758 nt, Artificial Sequence; identical to SEQ ID NO: 87656
  derived and/or modified sequence opt1 from hemagglutinin__InfluenzaB__AET43135

SEQ ID NO: 87697 - RNA, 1758 nt, Artificial Sequence; identical to SEQ ID NO: 87656
  derived and/or modified sequence opt1 from hemagglutinin__InfluenzaB__AET43146

SEQ ID NO: 87698 - RNA, 1758 nt, Artificial Sequence; identical to SEQ ID NO: 87656
  derived and/or modified sequence opt1 from hemagglutinin__InfluenzaB__AET43157

SEQ ID NO: 87699 - RNA, 1758 nt, Artificial Sequence
  derived and/or modified sequence opt1 from hemagglutinin__InfluenzaB__AET43168
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacgugacccucgggcgccccaagugcacgggcaagaucccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgccccgggcgggcccuacaagaucggcacguccgggagcugccccaacgucaccaacggcaacggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 87700 - RNA, 1758 nt, Artificial Sequence; identical to SEQ ID NO: 87656
  derived and/or modified sequence opt1 from hemagglutinin__InfluenzaB__AET43179

SEQ ID NO: 87701 - RNA, 1758 nt, Artificial Sequence; identical to SEQ ID NO: 87656
  derived and/or modified sequence opt1 from hemagglutinin__InfluenzaB__AET43190

SEQ ID NO: 87702 - RNA, 1758 nt, Artificial Sequence
  derived and/or modified sequence opt1 from hemagglutinin__InfluenzaB__AET43201
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccggcaacgcgcccgggggccccuacaagaucgggaccuccggcagcugccccaacgucacgaacggcaacggguucuucgccaccauggccugggccgugcccaagaacgacaagaacaagaccgcgaccaacccgcucacgaucgaggugcccuacaucugcaccgagggcgaggaccagaucaccgucuggggguuccacuccgacaacgagacccagauggccaagcuguacggcgacagcaagccccagaaguucacguccagcgccaacggcgugaccacccacuacgugucccagaucgggggcuuccccaaccagaccgaggacgggggccugccgcagagcgggcggaucgucguggacuacauggugcagaaguccggcaagacgggcaccaucaccuaccagcgcgggauccuccugccccagaaggucuggugcgccagcggccgguccaaggugaucaaggggagccugccccucaucggcgaggccgacugccugcacgagaaguacgggggccugaacaagagcaagcccuacuacaccggcgagcacgcgaaggccaucgggaacugcccgaucugggugaagacgccccucaagcuggccaacggcaccaaguaccgcccgcccgccaagcugcucaaggagcggggguucuucggcgccaucgcgggguuccuggagggcggcugggaggggaugaucgccggcuggcacggguacaccucccacggcgcccacggcgucgccguggccgcggaccugaaguccacccaggaggccaucaacaagaucacgaagaaccucaacucccugagcgagcuggaggucaagaaccuccagcgccuguccggggccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggccgagcgccgucgagaucggcaacgggugcuucgagaccaagcacaagugcaaccagaccugccuggaccggaucgccgccggcaccuucgacgcgggcgaguucucccuccccacguucgacagccugaacaucaccgccgccucccugaacgacgacgggcucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87703 - RNA, 1758 nt, Artificial Sequence; identical to SEQ ID NO: 87656
  derived and/or modified sequence opt1 from hemagglutinin__InfluenzaB__AET43212

SEQ ID NO: 87704 - RNA, 1758 nt, Artificial Sequence; identical to SEQ ID NO: 87656
  derived and/or modified sequence opt1 from hemagglutinin__InfluenzaB__AET43223

SEQ ID NO: 87705 - RNA, 1758 nt, Artificial Sequence; identical to SEQ ID NO: 87702
  derived and/or modified sequence opt1 from hemagglutinin__InfluenzaB__AET50943

SEQ ID NO: 87706 - RNA, 1758 nt, Artificial Sequence; identical to SEQ ID NO: 87656
  derived and/or modified sequence opt1 from hemagglutinin__InfluenzaB__AET50954

SEQ ID NO: 87707 - RNA, 1758 nt, Artificial Sequence; identical to SEQ ID NO: 87656
  derived and/or modified sequence opt1 from hemagglutinin__InfluenzaB__AET50965

SEQ ID NO: 87708 - RNA, 1758 nt, Artificial Sequence; identical to SEQ ID NO: 87656
  derived and/or modified sequence opt1 from hemagglutinin__InfluenzaB__AET50976

SEQ ID NO: 87709 - RNA, 1758 nt, Artificial Sequence; identical to SEQ ID NO: 87656
  derived and/or modified sequence opt1 from hemagglutinin__InfluenzaB__AET74255

SEQ ID NO: 87710 - RNA, 1758 nt, Artificial Sequence; identical to SEQ ID NO: 87702
  derived and/or modified sequence opt1 from hemagglutinin__InfluenzaB__AET74277

SEQ ID NO: 87711 - RNA, 1758 nt, Artificial Sequence; identical to SEQ ID NO: 87656
  derived and/or modified sequence opt1 from hemagglutinin__InfluenzaB__AET74288

SEQ ID NO: 87712 - RNA, 1758 nt, Artificial Sequence
  derived and/or modified sequence opt1 from hemagglutinin__InfluenzaB__AET74299
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacgugacccucgggcgccccaagugcacgggcaagaucccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgccccgggcgggcccuacaagaucggcacguccgggagcugccccaacgucaccaacggcaacggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaacaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 87713 - RNA, 1758 nt, Artificial Sequence; identical to SEQ ID NO: 87656
  derived and/or modified sequence opt1 from hemagglutinin__InfluenzaB__AET74329

SEQ ID NO: 87714 - RNA, 1758 nt, Artificial Sequence; identical to SEQ ID NO: 87656
  derived and/or modified sequence opt1 from hemagglutinin__InfluenzaB__AET74340

SEQ ID NO: 87715 - RNA, 1758 nt, Artificial Sequence; identical to SEQ ID NO: 87656
  derived and/or modified sequence opt1 from hemagglutinin__InfluenzaB__AET74351

SEQ ID NO: 87716 - RNA, 1758 nt, Artificial Sequence; identical to SEQ ID NO: 87653
  derived and/or modified sequence opt1 from hemagglutinin__InfluenzaB__AEY69077

SEQ ID NO: 87717 - RNA, 1758 nt, Artificial Sequence; identical to SEQ ID NO: 87653
  derived and/or modified sequence opt1 from hemagglutinin__InfluenzaB__AFB77676

SEQ ID NO: 87718 - RNA, 1758 nt, Artificial Sequence
  derived and/or modified sequence opt1 from hemagglutinin__InfluenzaB__AFB77677
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugcuucaacugcaccgaccuggacguggcccuggggcgccccaagugcaccggcaagaucccguccgcccgggugagcauccuccacgagguccgccccgugacguccggcugcuuccccaucaugcacgaccggaccaagauccgccagcugcccaaccugcuccggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagcccuacuacaccggcgagcacgcgaaggccaucggcaacugcccgaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 87719 - RNA, 1758 nt, Artificial Sequence; identical to SEQ ID NO: 87653
  derived and/or modified sequence opt1 from hemagglutinin__InfluenzaB__AFB77678

SEQ ID NO: 87720 - RNA, 1758 nt, Artificial Sequence; identical to SEQ ID NO: 87653
  derived and/or modified sequence opt1 from hemagglutinin__InfluenzaB__AFB77679

SEQ ID NO: 87721 - RNA, 1758 nt, Artificial Sequence
  derived and/or modified sequence opt1 from hemagglutinin__InfluenzaB__AFB77680
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccaucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgugacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 87722 - RNA, 1758 nt, Artificial Sequence; identical to SEQ ID NO: 87653
  derived and/or modified sequence opt1 from hemagglutinin__InfluenzaB__AFB77681

SEQ ID NO: 87723 - RNA, 1758 nt, Artificial Sequence
  derived and/or modified sequence opt1 from hemagglutinin__InfluenzaB__AFB77682
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgcagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 87724 - RNA, 1758 nt, Artificial Sequence; identical to SEQ ID NO: 87653
  derived and/or modified sequence opt1 from hemagglutinin__InfluenzaB__AFB77683

SEQ ID NO: 87725 - RNA, 1758 nt, Artificial Sequence; identical to SEQ ID NO: 87653
  derived and/or modified sequence opt1 from hemagglutinin__InfluenzaB__AFB77684

SEQ ID NO: 87726 - RNA, 1758 nt, Artificial Sequence
  derived and/or modified sequence opt1 from hemagglutinin__InfluenzaB__AFB77685
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagacgccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacaucaccaacggcaacggcuucuucgccaccauggccugggccguccccaagaacgacaagaacaagaccgcgacgaacccgcucaccaucgaggugcccuacaucugcaccgagggggaggaccagaucaccguguggggcuuccacuccgacaacgagacgcagauggccaagcuguacggggacagcaagccccagaaguucaccuccagcgccaacggcgucaccacccacuacaucucccagaucggcggguuccccaaccagacggaggacggcgggcugccgcagagcggccggaucgugguggacuacaugguccagaaguccgagaagaccgggaccaucaccuaccagcgcggcauccuccugccccagaagguguggugcgccagcggccgguccaaggugaucaaggggagccugccccucaucggcgaggccgacugccugcacgagaaguacgggggccugaacaagagcaagcccuacuacacgggggagcacgcgaaggccaucggcaacugcccgaucugggucaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacgggguggccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgagggcaucaucaacuccgaggacgagcaccuccuggcgcuggagcgcaagcucaagaagaugcuggggcccagcgccguggagaucggcaacgggugcuucgagaccaagcacaagugcaaccagaccugccuggaccggaucgccgccggcacguucgacgcgggggaguucucccuccccaccuucgacagccugaacaucaccgccgccucccugaacgacgacggccucgacaaccacaccauccugcuguacuacagcacggccgccuccagccuggcggugacccucaugaucgccaucuucgucguguacauggugucccgcgacaacgucagcugcuccaucugccuguga

SEQ ID NO: 87727 - RNA, 1758 nt, Artificial Sequence
  derived and/or modified sequence opt1 from hemagglutinin__InfluenzaB__AFB77686
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucagcggcuuccccaaccagaccgaggacgggggccugccgcaguccgggcggaucguggucgacuacauggugcagaaguccggcaagacggggaccaucaccuaccagcgcggcauccuccugccccagaagguguggugcgccuccggccggagcaaggucaucaaggggagccugccccucaucggcgaggccgacugccugcacgagaaguacgggggccugaacaaguccaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccagccacggcgcccacgggguggccgucgccgcggaccugaaguccacccaggaggccaucaacaagaucacgcagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccguggagaucggcaacgggugcuucgagaccaagcacaagugcaaccagaccugccuggaccggaucgccgccggcaccuucgacgcgggggaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 87728 - RNA, 1758 nt, Artificial Sequence
  derived and/or modified sequence opt1 from hemagglutinin__InfluenzaB__AFB77687
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacaucaagcugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccgcaucgucguggacuacauggugcagaaguccgggaagacgggcaccaucaccuaccagcggggcauccuccugccccagaaggucuggugcgccagcgggcgcuccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 87729 - RNA, 1758 nt, Artificial Sequence
  derived and/or modified sequence opt1 from hemagglutinin__InfluenzaB__AFB77688
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaaggcgccccucaagcuggccaacgggacgaaguaccgcccgcccgccaagcugcucaaggagcggggcuucuucggggccaucgccggcuuccuggagggcgggugggagggcaugaucgccggguggcacggcuacaccucccacggggcccacggcgucgccguggcggccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgcggugcugcugagcaacgaggggaucaucaacuccgaggacgagcaccuccuggcccuggagcgcaagcucaagaagaugcugggccccagcgccgucgagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucguggucuacauggugucccgcgacaacgugagcugcuccaucugccuguga

SEQ ID NO: 87730 - RNA, 1758 nt, Artificial Sequence; identical to SEQ ID NO: 87653
  derived and/or modified sequence opt1 from hemagglutinin__InfluenzaB__AFB77689

SEQ ID NO: 87731 - RNA, 1758 nt, Artificial Sequence; identical to SEQ ID NO: 87653
  derived and/or modified sequence opt1 from hemagglutinin__InfluenzaB__AFB77690

SEQ ID NO: 87732 - RNA, 1758 nt, Artificial Sequence; identical to SEQ ID NO: 87691
  derived and/or modified sequence opt1 from hemagglutinin__InfluenzaB__AFE00360

SEQ ID NO: 87733 - RNA, 1758 nt, Artificial Sequence; identical to SEQ ID NO: 87691
  derived and/or modified sequence opt1 from hemagglutinin__InfluenzaB__AFF18534

SEQ ID NO: 87734 - RNA, 1758 nt, Artificial Sequence; identical to SEQ ID NO: 87691
  derived and/or modified sequence opt1 from hemagglutinin__InfluenzaB__AFF18543

SEQ ID NO: 87735 - RNA, 1758 nt, Artificial Sequence; identical to SEQ ID NO: 87653
  derived and/or modified sequence opt1 from hemagglutinin__InfluenzaB__AFG48978

SEQ ID NO: 87736 - RNA, 1758 nt, Artificial Sequence; identical to SEQ ID NO: 87653
  derived and/or modified sequence opt1 from hemagglutinin__InfluenzaB__AFG48997

SEQ ID NO: 87737 - RNA, 1758 nt, Artificial Sequence
  derived and/or modified sequence opt1 from hemagglutinin__InfluenzaB__AFG48998
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgagaccauggccugggccgugccgaagaacgacaagaacaagaccgccaccaacccccugacgaucgaggugcccuacaucugcaccgagggggaggaccagaucaccgucuggggcuuccacuccgacaacgagacccagauggcgaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccucccacggggcccacggcgucgccguggccgccgaccugaaguccacccaggaggcgaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcccuggagcgcaagcugaagaagaugcucggccccagcgcggucgagaucgggaacggcugcuucgagaccaagcacaagugcaaccagaccugccuggaccggaucgccgccgggaccuucgacgccggcgaguucucccugcccacguucgacagccucaacaucaccgcggccucccugaacgacgacggccuggacaaccacaccauccuccuguacuacagcaccgccgccuccagccuggccgugacgcugaugaucgcgaucuucguggucuacauggugucccgcgacaacgugagcugcuccaucugccucuga

SEQ ID NO: 87738 - RNA, 1755 nt, Artificial Sequence
  derived and/or modified sequence opt1 from hemagglutinin__InfluenzaB__AFG49012
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccggaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccuccuuccuggagggcgggugggagggcaugaucgccggguggcacggcuacaccagccacggcgcccacgggguggccgucgcggccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggccgacacgaucuccagccagaucgagcuggcgguccugcucuccaacgaggggaucaucaacagcgaggacgagcaccuccuggcccuggagcgcaagcugaagaagaugcugggccccuccgccguggacaucggcaacgggugcuucgagaccaagcacaagugcaaccagaccugccucgaccggaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgcgacaacguguccugcagcaucugccucuga

SEQ ID NO: 87739 - RNA, 1755 nt, Artificial Sequence
  derived and/or modified sequence opt1 from hemagglutinin__InfluenzaB__AFG49013
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcggaucgucguggacuacaugaugcagaagccgggcaagacggggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccucuga

SEQ ID NO: 87740 - RNA, 1755 nt, Artificial Sequence
  derived and/or modified sequence opt1 from hemagglutinin__InfluenzaB__AFH57865
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccccaugaagaaccuguacggcgacagcaacccccagaaguucacguccagcgccaacggggugaccacccacuacgugucccagaucggcggcuucccggaccagaccgaggacgggggccucccccagagcgggcgcaucgucguggacuacaugaugcagaagcccggcaagacggggaccaucguguaccagcggggcguccugcugccccagaagguguggugcgccuccggccgcagcaaggugaucaaggggagccucccgcugaucggcgaggcggacugccugcacgagaaguacgggggccucaacaaguccaagcccuacuacaccggggagcacgccaaggccaucggcaacugccccaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87741 - RNA, 1755 nt, Artificial Sequence
  derived and/or modified sequence opt1 from hemagglutinin__InfluenzaB__AFH57876
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagaaccagaugaagaaccuguacggcgacagcaacccccagaaguucaccuccagcgccaacggggugacgacccacuacgugucccagaucggcagcuuccccgaccagaccgaggacggcgggcucccgcaguccggccgcaucgucguggacuacaugaugcagaagcccgggaagaccggcacgaucguguaccagcgggggauccugcugccccagaaggucuggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacaccaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucguguacauggucucccgggacaacgugagcugcagcaucugccucuga

SEQ ID NO: 87742 - RNA, 1755 nt, Artificial Sequence
  derived and/or modified sequence opt1 from hemagglutinin__InfluenzaB__AFH57942
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagaaccagaugaagucccuguacggcgacagcaacccccagaaguucaccuccagcgccaacggggugacgacccacuacgugucccagaucggcgacuuccccgaccagaccgaggacggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagacgaagcacaagugcaaccagaccugccucgaccgcaucgccgcggggaccuucaacgccggcgaguucagccugcccaccuucgacucccugaacaucaccgccgccagccucaacgacgacgggcuggacaaccacacgauccugcuguacuacuccaccgccgcgagcucccucgccgugacccugaugcuggccaucuucaucgucuacauggugagccgggacaacguguccugcagcaucugccucuga

SEQ ID NO: 87743 - RNA, 1752 nt, Artificial Sequence
  derived and/or modified sequence opt1 from hemagglutinin__InfluenzaB__AFH57986
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagcgcgccccgggcgggcccuaccggcucggcacguccgggagcugccccaacgucaccucccgcgacggcuucuucgccaccauggccugggcggugccccgggacaacaagaccgccacgaacccgcugaccguggagguccccuacaucugcaccaagggcgaggaccagaucaccguguggggguuccacagcgacgacaagacgcagaugaagaaccuguacggcgacuccaacccccagaaguucaccagcuccgccaacggggugaccacccacuacgucagccagaucggcggcuuccccaaccagacggaggacgggggccucccgcaguccgggcgcaucgugguggacuacaugguccagaagcccggcaagaccgggaccaucguguaccagcggggcgugcugcugccccagaaggucuggugcgccagcggccgcuccaaggugaucaaggggagccucccccugaucggcgaggccgacugccugcacgagaaguacgggggccucaacaagagcaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacgggguggccguggccgcggaccucaagagcacccaggaggccaucaacaagaucacgaagaaccugaacucccugagcgagcucgaggucaagaaccugcagcggcuguccggcgccauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcgcuggagcggaagcugaagaagaugcuggggcccagcgccgucgacaucggcaacgggugcuucgagaccaagcacaagugcaaccagaccugccucgaccgcaucgccgccggcaccuucaacgcgggggaguucucccugcccacguucgacagccugaacaucaccgccgccucccucaacgacgacggccuggacaaccacaccauccugcuguacuacagcaccgccgccuccagccucgcggugacgcugaugaucgccaucuucaucguguacauggucucccgggacaacgugagcugcuccaucugccuguga

SEQ ID NO: 87744 - RNA, 1758 nt, Artificial Sequence
  derived and/or modified sequence opt1 from hemagglutinin__InfluenzaB__AFH58249
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccgcccgccaagguguccauccugcacgagguccggcccgugacgagcggcugcuuccccaucaugcacgaccgcaccaagauccggcagcugccgaaccuccugcgcggguacgagcggauccgccuguccaaccacaacgugaucaacgccgaggaggcgcccggcgggcccuacaagaucggcaccagcggguccugccccaacgucaccaacggcaacggcuucuucgccacgauggccugggccgugccgaagaacgagaacaacaagaccgcgaccaacagccucaccaucgaggugcccuacaucugcacggagggggaggaccagaucaccgucuggggcuuccacuccgacagcgagacccagauggccaagcuguacggggacuccaagccccagaaguucaccagcuccgccaacggcgugacgacccacuacgugagccagaucggcggguuccccaaccagaccgaggacggcgggcugccgcaguccggccggaucgucguggacuacauggugcagaaguccgggaagaccggcacgaucaccuaccagcgcggcauccuccugccccagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccacccugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucaacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87745 - RNA, 1758 nt, Artificial Sequence
  derived and/or modified sequence opt1 from hemagglutinin__InfluenzaB__AFH58260
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccagcaacggcgugacgacccacuacgugucccagaucggcggguuccccaaccagaccgaggacggcgggcugccccagagcggccgcaucgucguggacuacauggugcagaaguccgggaagaccggcacgaucaccuaccagcggggcauccuccugccgcagaaggucuggugcgccagcgggcgcagcaaggugaucaagggcucccugccccucaucggggaggccgacugccugcacgagcgguacggcgggcugaacaagagcaagcccuacuacaccggcgagcacgccaaggcgaucggcaacugccccaucugggugaagaccccgcucaagcuggccaacgggacgaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccaccuucgacagccugaacaucacggcggccucccugaacgacgacggccucgacaaccacaccauccugcuguacuacagcaccgccgccuccagccuggccgugacccucaugaucgcgaucuucguggucuacauggugucccgcgacaacgugagcugcagcaucugccuguga

SEQ ID NO: 87746 - RNA, 1755 nt, Artificial Sequence
  derived and/or modified sequence opt1 from hemagglutinin__InfluenzaB__AFH58271
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgaggucaagcccgugaccuccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacgacaagacccagaugaagaaccuguacggcgacagcaacccccagaaguucacguccagcgccaacggggugaccacccacuacgugucccagaucggcagcuuccccgaccagaccgaggacggcgggcucccgcaguccggccggaucgucguggacuacaugaugcagaagcccgggaagacgggcaccaucguguaccagcgcgggguccugcugccccagaagguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 87747 - RNA, 1755 nt, Artificial Sequence; identical to SEQ ID NO: 87746
  derived and/or modified sequence opt1 from hemagglutinin__InfluenzaB__AFH58282

SEQ ID NO: 87748 - RNA, 1758 nt, Artificial Sequence
  derived and/or modified sequence opt1 from hemagglutinin__InfluenzaB__AFH58293
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacgacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 87749 - RNA, 1755 nt, Artificial Sequence
  derived and/or modified sequence opt1 from hemagglutinin__InfluenzaB__AFH58304
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 87750 - RNA, 1755 nt, Artificial Sequence; identical to SEQ ID NO: 87749
  derived and/or modified sequence opt1 from hemagglutinin__InfluenzaB__AFH58315

SEQ ID NO: 87751 - RNA, 1755 nt, Artificial Sequence
  derived and/or modified sequence opt1 from hemagglutinin__InfluenzaB__AFH58326
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaaggcccagaugaagaaccuguacggcgacuccaacccccagaaguucaccagcuccgccaacggggugacgacccacuacgugagccagaucggcgacuuccccgaccagaccgaggacggcgggccgccccaguccggccgcaucgucguggacuacaugaugcagaagcccgggaagaccggcacgaucguguaccagcgcgggguccuccugccccagaagguguggugcgcgagcggccgguccaaggugaucaagggcagccugccgcucaucggggaggccgacugccugcacgagaaguacggcgggcugaacaagagcaagcccuacuacaccggcgagcacgccaaggccaucgggaacugccccaucugggucaagacgccccucaagcuggccaacggcaccaaguaccggccgcccgcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgcggacaccaucagcucccagaucgagcucgccguccugcugagcaacgagggcaucaucaacuccgaggacgagcaccuccuggcccuggagcggaagcucaagaagaugcugggccccagcgccguggacaucgggaacggcugcuucgagacgaagcacaagugcaaccagaccugccuggaccgcaucgcggccgggaccuucaacgccggcgaguucucccuccccaccuucgacagccugaacaucaccgccgccucccugaacgacgacgggcucgacaaccacacgauccugcuguacuacagcaccgcggccuccagccuggccgugacccucaugcuggccaucuucaucgucuacauggugucccgggacaacgugagcugcuccaucugccuguga

SEQ ID NO: 87752 - RNA, 1755 nt, Artificial Sequence
  derived and/or modified sequence opt1 from hemagglutinin__InfluenzaB__AFH58337
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaaggcccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgcgagcggccgguccaaggugaucaagggcagccucccccugaucggggaggccgacugccugcacgagaaguacggcgggcucaacaagagcaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgugacccugaugcuggccaucuucaucgucuacauggugucccgggacaacgugagcugcuccaucugccucuga

SEQ ID NO: 87753 - RNA, 1758 nt, Artificial Sequence
  derived and/or modified sequence opt1 from hemagglutinin__InfluenzaB__AFH58348
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcgcccacaacgugaucaacgcggagaacgccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccgucuggggcuuccacagcgacaaggagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuucaacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgcgacaacguguccugcagcaucugccuguga

SEQ ID NO: 87754 - RNA, 1758 nt, Artificial Sequence
  derived and/or modified sequence opt1 from hemagglutinin__InfluenzaB__AFH58370
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcgcccacaacgugaucaacgcggagaacgccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccgucuggggcuuccacagcgacaacgagauccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucaacgccggcgaguucagccuccccaccuucgacucccugaacaucaccgccgccagccugaacgacgacggccucgacaaccacacgauccugcuguacuacuccaccgccgcgagcucccuggccgugacccucaugaucgccaucuucguggucuacauggugagccgcgacaacguguccugcagcaucugccuguga

SEQ ID NO: 87755 - RNA, 1758 nt, Artificial Sequence
  derived and/or modified sequence opt1 from hemagglutinin__InfluenzaB__AFH58392
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagauccagauggccaagcuguacggggacagcaagccccagaaguucaccuccagcgccaacggcgucacgacccacuacgugucccagaucggcggguuccccaaccagaccgaggacggcgggcugccgcagagcggccggaucguggucgacuacauggugcagaaguccgggaagaccggcacgaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggucacccucaugaucgccaucuucgugguguacauggucucccgcgacaacgugagcugcuccaucugccuguga

SEQ ID NO: 87756 - RNA, 1758 nt, Artificial Sequence; identical to SEQ ID NO: 87748
  derived and/or modified sequence opt1 from hemagglutinin__InfluenzaB__AFH58403

SEQ ID NO: 87757 - RNA, 1758 nt, Artificial Sequence; identical to SEQ ID NO: 87748
  derived and/or modified sequence opt1 from hemagglutinin__InfluenzaB__AFH58414

SEQ ID NO: 87758 - RNA, 1758 nt, Artificial Sequence; identical to SEQ ID NO: 87748
  derived and/or modified sequence opt1 from hemagglutinin__InfluenzaB__AFH58425

SEQ ID NO: 87759 - RNA, 1758 nt, Artificial Sequence; identical to SEQ ID NO: 87748
  derived and/or modified sequence opt1 from hemagglutinin__InfluenzaB__AFH58436

SEQ ID NO: 87760 - RNA, 1758 nt, Artificial Sequence
  derived and/or modified sequence opt1 from hemagglutinin__InfluenzaB__AFH58458
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcaccaacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagauccagauggccaagcuguacggggacagccggccccagaaguucaccuccagcgccaacggcgugacgacccacuacgugucccagaucggcggguuccccaaccagaccgaggacggcgggcugccgcagagcggccgcaucgucguggacuacauggugcagaaguccgggaagaccggcacgaucaccuaccagcggggcauccuccugccccagaaggucuggugcgccagcgggcgcuccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcggcuguccggcgccauggacgagcugcacaacgagauccucgagcuggacgagaagguggacgaccugcgcgccgacacgaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgggacaacgugagcugcuccaucugccuguga

SEQ ID NO: 87761 - RNA, 1758 nt, Artificial Sequence; identical to SEQ ID NO: 87760
  derived and/or modified sequence opt1 from hemagglutinin__InfluenzaB__AFH58469

SEQ ID NO: 87762 - RNA, 1755 nt, Artificial Sequence; identical to SEQ ID NO: 87742
  derived and/or modified sequence opt1 from hemagglutinin__InfluenzaB__AFH58480

SEQ ID NO: 87763 - RNA, 1755 nt, Artificial Sequence
  derived and/or modified sequence opt1 from hemagglutinin__InfluenzaB__AFH58502
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87764 - RNA, 1758 nt, Artificial Sequence
  derived and/or modified sequence opt1 from hemagglutinin__InfluenzaB__AFH58513
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacgacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 87765 - RNA, 1758 nt, Artificial Sequence; identical to SEQ ID NO: 87764
  derived and/or modified sequence opt1 from hemagglutinin__InfluenzaB__AFH58524

SEQ ID NO: 87766 - RNA, 1755 nt, Artificial Sequence
  derived and/or modified sequence opt1 from hemagglutinin__InfluenzaB__AFH58535
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcagacccggggcaagcucugccccaacugcuucaacugcaccgaccuggacguggcccuggggcgccccaagugcaugggcaacaccccguccgccaaggugagcauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgccgggcgggcccuacaaggugggcaccagcggguccugccccaacgucgccaacggcaacggcuucuucaacaccauggccugggugauccccaaggacaacaacaagaccgccaucaacccggugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccguggccgccgaccucaaguccacccaggaggccaucaacaagaucaccaagaaccugaacuaccugagcgagcucgaggucaagaaccugcagcggcuguccggcgcgaugaacgagcuccacgacgagauccuggagcuggacgagaagguggacgaccuccgcgccgacaccaucagcucccagaucgagcuggccgugcugcucagcaacgagggcaucaucaacuccgaggacgagcaccuccuggcccuggagcggaagcugaagaagaugcuggggcccagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacggccuggacaaccacacgauccugcucuacuacagcaccgccgccuccagccuggccgugacccugaugaucgccaucuucaucguguacauggucucccgggacaacgugagcugcuccaucugccuguga

SEQ ID NO: 87767 - RNA, 1752 nt, Artificial Sequence
  derived and/or modified sequence opt1 from hemagglutinin__InfluenzaB__AFH58557
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagcgcgccccgggcgggcccuaccggcucggcacguccgggagcugccccaacgucaccucccgcgacggcuucuucgccaccauggccugggcggugccccgggacaacaagaccgccacgaacccgcugaccguggagguccccuacaucugcaccaagggcgaggaccagaucaccguguggggguuccacagcgacgacaagacgcagaugaagaaccuguacggcgacuccaacccccagaaguucaccagcuccgccaacggggugaccacccacuacgucagccagaucggcggcuuccccaaccagacggaggacgggggccucccgcaguccgggcgcaucgugguggacuacaugguccagaagcccggcaagaccgggaccaucguguaccagcggggcgugcugcugccccagaaggucuggugcgccagcggccgcuccaaggugaucaaggggagccucccccugaucggcgaggccgacugccugcacgagaaguacgggggccucaacaagagcaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccacggcgcccacgggguggccguggccgcggaccucaagagcacccaggaggccaucaacaagaucacgaagaaccugaacucccugagcgagcucgaggucaagaaccugcagcggcuguccggcgccauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcgcuggagcggaagcugaagaagaugcuggggcccagcgccgucgacaucggcaacgggugcuucgagaccaagcacaagugcaaccagaccugccucgaccgcaucgccgccggcaccuucaacgcgggggaguucuccuuccccacguucgacagccugaacaucaccgccgccucccugaacgacgacggccucgacaaccacaccauccugcuguacuacagcaccgccgccuccagccuggcggugacgcucaugaucgccaucuucaucguguacauggucucccgggacaacgugagcugcuccaucugccuguga

SEQ ID NO: 87768 - RNA, 1755 nt, Artificial Sequence
  derived and/or modified sequence opt1 from hemagglutinin__InfluenzaB__AFJ76224
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggucccccaugugcgugggcaucacgcccagcgccaaggccuccauccugcacgagguccgccccgugaccagcggcugcuuccccaucaugcacgaccggaccaagauccgccagcugcccaaccuccugcggggguacgagaagauccgccuguccacccagaacgugaucaacaucgagaaggcgccgggcgggcccuaccggcucggcacgagcggguccugccccaacgccaccagccgcuccggcuucuucgccaccauggccugggcggucccccgggacaacaacaagaccgccacgaacccgcugaccguggaggugccccacaucugcaccaaggaggaggaccagaucaccgucuggggcuuccacagcgacaacaagacgcagaugaagaaccuguacggggacuccaacccccagaaguucaccagcuccgccaacggcgugaccacccacuacgugagccagaucgggggcuuccccgaccagacggaggacggcgggcucccgcaguccggccgcaucgucguggacuacauggugcagaagcccgggaagaccggcaccaucgucuaccagcgggggauccugcugccccagaagguguggugcgccagcggccgcagcaaggugaucaagggcucccucccccugaucggggaggccgacugccugcacgagaaguacggcgggcucaacaagagcaagccguacuacaccggcgagcacgcgaaggccaucgggaacugccccaucugggucaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccacggcguggccgucgccgcggaccucaagagcacccaggaggccaucaacaagaucacgaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggccguccugcucagcaacgagggcaucaucaacuccgaggacgagcaccuccuggcgcuggagcggaagcugaagaagaugcugggccccagcgccguggacaucgggaacggcugcuucgagaccaagcacaagugcaaccagaccugccucgaccgcaucgccgccgggaccuucaacgcgggcgaguucucccugcccacguucgacagccugaacaucaccgccgccucccucaacgacgacgggcuggacaaccacaccauccugcuguacuacagcaccgccgccuccagccucgcggugacgcugaugaucgccaucuucaucgucuacaugaucucccgggacaacgugagcugcagcaucugccuguga

SEQ ID NO: 87769 - RNA, 1755 nt, Artificial Sequence
  derived and/or modified sequence opt1 from hemagglutinin__InfluenzaB__AFJ76235
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggucccccaugugcgugggcaucacgccgagcgccaaggccuccauccugcacgagguccgccccgugaccagccggugcuuccccaucaugcacgaccgcaccaagauccggcagcugcccaaccuccugcgcggcuacgagaagauccggcuguccacccagaacgugaucaacaucgagaaggcgcccgggggccccuaccgccucgggacgagcggcuccugccccaacgccaccagccgguccggguucuucgccaccauggccugggcggucccccgcgacaacaacaagaccgccacgaacccgcugaccguggaggugccccacaucugcaccaaggaggaggaccagaucaccgucuggggcuuccacagcgacaacaagacgcagaugaagaaccuguacggcgacuccaacccccagaaguucaccagcuccgccaacggggugaccacccacuacgugagccagaucggcggguuccccgaccagacggaggacggcggccucccgcaguccgggcggaucgucguggacuacauggugcagaagcccggcaagaccgggaccaucgucuaccagcgcggcauccugcugccccagaagguguggugcgccagcgggcggagcaaggugaucaagggcucccucccccugaucggcgaggccgacugccugcacgagaaguacgggggccucaacaagagcaagccguacuacaccggggagcacgcgaaggccaucggcaacugccccaucugggucaagacgccccugaagcuggccaacgggaccaaguaccggcccccggccaagcuccugaaggagcgcggcuucuucggcgccaucgcgggguuccuggagggcgggugggagggcaugaucgccggguggcacggcuacaccucccacggcgcccacgggguggccgucgccgcggaccucaagagcacccaggaggccaucaacaagaucacgaagaaccugaacucccugagcgagcucgaggugaagaaccugcagcgccuguccggcgccauggacgagcuccacaacgagauccuggagcuggacgagaagguggacgaccuccgggccgacaccaucagcucccagaucgagcuggccguccugcucagcaacgaggggaucaucaacuccgaggacgagcaccuccuggcgcuggagcgcaagcugaagaagaugcugggccccagcgccguggacaucggcaacgggugcuucgagaccaagcacaagugcaaccagaccugccucgaccggaucgccgccggcaccuucaacgcgggggaguucucccugcccacguucgacagccugaacaucaccgccgccucccucaacgacgacggccuggacaaccacaccauccugcuguacuacagcaccgccgccuccagccucgcggugacgcugaugaucgccaucuucaucgucuacaugaucucccgcgacaacgugagcugcagcaucugccuguga

SEQ ID NO: 87770 - RNA, 1755 nt, Artificial Sequence; identical to SEQ ID NO: 87768
  derived and/or modified sequence opt1 from hemagglutinin__InfluenzaB__AFJ76246

SEQ ID NO: 87771 - RNA, 1758 nt, Artificial Sequence; identical to SEQ ID NO: 87522
  derived and/or modified sequence opt1 from hemagglutinin__InfluenzaB__AFJ76268

SEQ ID NO: 87772 - RNA, 1758 nt, Artificial Sequence; identical to SEQ ID NO: 87573
  derived and/or modified sequence opt1 from hemagglutinin__InfluenzaB__AFJ76301

SEQ ID NO: 87773 - RNA, 1755 nt, Artificial Sequence; identical to SEQ ID NO: 87434
  derived and/or modified sequence opt1 from hemagglutinin__InfluenzaB__AFJ76323

SEQ ID NO: 87774 - RNA, 1758 nt, Artificial Sequence
  derived and/or modified sequence opt1 from hemagglutinin__InfluenzaB__AFJ76334
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcggguggaagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccguguucgucguguacauggugucccgcgacaacgucagcugcagcaucugccuguga

SEQ ID NO: 87775 - RNA, 1758 nt, Artificial Sequence; identical to SEQ ID NO: 87522
  derived and/or modified sequence opt1 from hemagglutinin__InfluenzaB__AFJ77327

SEQ ID NO: 87776 - RNA, 1755 nt, Artificial Sequence; identical to SEQ ID NO: 87434
  derived and/or modified sequence opt1 from hemagglutinin__InfluenzaB__AFJ77369

SEQ ID NO: 87777 - RNA, 1755 nt, Artificial Sequence; identical to SEQ ID NO: 87434
  derived and/or modified sequence opt1 from hemagglutinin__InfluenzaB__AFJ77380

SEQ ID NO: 87778 - RNA, 1755 nt, Artificial Sequence
  derived and/or modified sequence opt1 from hemagglutinin__InfluenzaB__AFJ80139
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcuuccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucacgaagaaccugaacucccugagcgagcucgaggugaagaaccugcagcgccuguccggggccauggacgagcuccacaacgagauccuggagcuggacgagaagguggacgaccuccgggccgacaccaucagcucccagaucgagcuggcgguccugcucagcaacgagggcaucaucaacuccgaggacgagcaccuccuggcccuggagcgcaagcugaagaagaugcugggccccagcgccguggacaucgggaacggcugcuucgagaccaagcacaagugcaaccagaccugccucgaccggaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugaucgccaucuucaucgucuacaugaucucccgcgacaacgugagcugcuccaucugccuguga

SEQ ID NO: 87779 - RNA, 1755 nt, Artificial Sequence
  derived and/or modified sequence opt1 from hemagglutinin__InfluenzaB__AFJ80150
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcgccugagcggggccauggacgagcuccacaacgagauccuggagcuggacgagaagguggacgaccuccgggccgacaccaucuccagccagaucgagcuggcgguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgcgacaacguguccugcagcaucugccuguga

SEQ ID NO: 87780 - RNA, 1755 nt, Artificial Sequence
  derived and/or modified sequence opt1 from hemagglutinin__InfluenzaB__AFJ80161
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccucccggagcggcuucuucgcgaccauggccugggccgugccccgcgacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccggaucgugguggacuacaugguccagaagcccgggaagaccggcaccaucguguaccagcgcgggauccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcgccugagcggggccauggacgagcuccacaacgagauccuggagcuggacgagaaggucgacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucuuccgcgacaacgugagcugcuccaucugccuguga

SEQ ID NO: 87781 - RNA, 1755 nt, Artificial Sequence
  derived and/or modified sequence opt1 from hemagglutinin__InfluenzaB__AFJ80172
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucggggacuuccccgaccagacggaggacggcggccucccgcagagcgggcggaucgucguggacuacauggugcagaagcccggcaagaccgggaccaucgucuaccagcgcggcauccugcugccccagaagguguggugcgccuccgggcggagcaaggugaucaagggcagccucccccugaucggcgaggcggacugccugcacgagaaguacgggggccucaacaaguccaagccguacuacaccggggagcacgccaaggccaucggcaacugccccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccagccacggcgcccacgggguggccgucgcggccgaccucaaguccacccaggaggccaucaacaagaucacgaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggcgguccugcucuccaacgaggggaucaucaacagcgaggacgagcaccuccuggcccuggagcgcaagcugaagaagaugcugggccccuccgccguggacaucggcaacgggugcuucgagaccaagcacaagugcaaccagaccugccucgaccggaucgccgcgggcaccuucaacgccggggaguucagccugcccacguucgacucccugaacaucaccgccgccagccucaacgacgacggccuggacaaccacaccauccugcuguacuacuccaccgccgcgagcucccucgccgugacgcugaugaucgccaucuucaucgucuacaugaucagccgcgacaacguguccugcagcaucugccuguga

SEQ ID NO: 87782 - RNA, 1755 nt, Artificial Sequence; identical to SEQ ID NO: 87768
  derived and/or modified sequence opt1 from hemagglutinin__InfluenzaB__AFJ80183

SEQ ID NO: 87783 - RNA, 1755 nt, Artificial Sequence; identical to SEQ ID NO: 87779
  derived and/or modified sequence opt1 from hemagglutinin__InfluenzaB__AFJ80194

SEQ ID NO: 87784 - RNA, 1755 nt, Artificial Sequence; identical to SEQ ID NO: 87768
  derived and/or modified sequence opt1 from hemagglutinin__InfluenzaB__AFJ80205

SEQ ID NO: 87785 - RNA, 1755 nt, Artificial Sequence; identical to SEQ ID NO: 87413
  derived and/or modified sequence opt1 from hemagglutinin__InfluenzaB__AFJ80216

SEQ ID NO: 87786 - RNA, 1755 nt, Artificial Sequence; identical to SEQ ID NO: 87768
  derived and/or modified sequence opt1 from hemagglutinin__InfluenzaB__AFJ80227

SEQ ID NO: 87787 - RNA, 1758 nt, Artificial Sequence
  derived and/or modified sequence opt1 from hemagglutinin__InfluenzaB__AFJ80238
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcauccacaacgugaucaacgccgagaaggcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 87788 - RNA, 1755 nt, Artificial Sequence
  derived and/or modified sequence opt1 from hemagglutinin__InfluenzaB__AFJ80656
augaaggccaucaucgugcugcucauggucgugaccagcaacgccgaccgcaucugcaccggcaucacguccagcaacagcccccacgugguccggaccgcgacccagggggaggugaacgugaccggcgucaucccgcugacgaccacccccaccaagucccacuucgccaaccugaaggggacgaagacccgcggcaagcucugcccgaccugccugaacugcaccgaccuggacguggcccucgggcggcccaugugcgugggcaucacgcccuccgccaaggccagcauccugcacgagguccgccccgugaccuccggcugcuuccccaucaugcacgaccggaccaagauccgccagcugcccaaccuccugcggggguacgagaagauccgccugagcacccagaacgugaucaacgcggagaaggccccgggcgggcccuaccggcucggcacguccgggagcugccccaacgccaccucccgcagcggcuucuucgccaccauggcgugggccgucccccgggacaacaacaagaccgccacgaacccgcugaccguggaggugccccacaucugcaccaaggaggaggaccagaucaccgucuggggcuuccacuccgacaacaagacgcagaugaagaaccuguacggggacagcaacccccagaaguucaccuccagcgccaacggcgugaccacccacuacgugucccagaucgggggcuuccccgaccagacggaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugaucgccaucuucaucgucuacaugaucagccgggacaacguguccugcagcaucugccuguga

SEQ ID NO: 87789 - RNA, 1755 nt, Artificial Sequence; identical to SEQ ID NO: 87768
  derived and/or modified sequence opt1 from hemagglutinin__InfluenzaB__AFJ80667

SEQ ID NO: 87790 - RNA, 1755 nt, Artificial Sequence; identical to SEQ ID NO: 87768
  derived and/or modified sequence opt1 from hemagglutinin__InfluenzaB__AFJ80678

SEQ ID NO: 87791 - RNA, 1755 nt, Artificial Sequence; identical to SEQ ID NO: 87768
  derived and/or modified sequence opt1 from hemagglutinin__InfluenzaB__AFJ80689

SEQ ID NO: 87792 - RNA, 1755 nt, Artificial Sequence
  derived and/or modified sequence opt1 from hemagglutinin__InfluenzaB__AFJ80711
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaucaaguccuacuucgccaaccugaaggggaccaagacgcggggcaagcucugccccgacugccugaacugcaccgaccuggacguggcccucgggcgccccaugugcgugggcaccaccccguccgccaaggccagcauccugcacgagguccggcccgugacguccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcaccuccgggagcugccccaacgccacguccaagagcggcuucuucgccaccauggcgugggccguccccaaggacaacaacaagaacgccaccaacccgcugaccguggaggugcccuacgucugcacggagggcgaggaccagaucaccguguggggguuccacuccgacaacaagacccagaugaagaaccuguacggcgacagcaacccccagaaguucaccuccagcgccaacggggugacgacccacuacgucucccagaucggcggcuuccccgaccagaccgaggacgggggccucccgcagagcgggcggaucgugguggacuacaugguccagaagcccggcaagaccgggacgaucguguaccagcgcggcgugcugcugccccagaaggucuggugcgccuccggccggagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagacgaagcacaagugcaaccagaccugccucgaccggaucgccgcgggcaccuucaacgccggggaguucagccugcccaccuucgacucccugaacaucaccgccgccagccucaacgacgacggccuggacaaccacacgauccugcuguacuacuccaccgccgcgagcucccucgccgugacccugaugcuggccaucuucaucguguacauggucagccgcgacaacguguccugcagcaucugccucuga

SEQ ID NO: 87793 - RNA, 1755 nt, Artificial Sequence; identical to SEQ ID NO: 87792
  derived and/or modified sequence opt1 from hemagglutinin__InfluenzaB__AFJ80722

SEQ ID NO: 87794 - RNA, 1755 nt, Artificial Sequence
  derived and/or modified sequence opt1 from hemagglutinin__InfluenzaB__AFJ80733
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcaugggcaccacgccguccgccaaggccagcauccugcacgaggugcgccccgucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccgacgccaccaacaaguccggcuucuucgccaccauggcgugggccgugcccaaggacaacaacaagaacgccaccaacccgcugacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcggcuuccccgaccagaccgaggacgggggccucccgcaguccgggcgcaucguggucgacuacaugaugcagaagcccggcaagacggggaccaucguguaccagcggggcgugcugcugccccagaaggucuggugcgccagcggccgcuccaaggugaucaaggggagccucccccugaucggcgaggcggacugccugcacgagaaguacgggggccucaacaagagcaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacggggucgccguggcggccgaccucaagagcacccaggaggccaucaacaagaucaccaagaaccugaacucccugagcgagcucgaggucaagaaccugcagcggcuguccggcgccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcuggggcccagcgccgucgacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucguguacauggucucccgggacaacgugagcugcuccaucugccucuga

SEQ ID NO: 87795 - RNA, 1758 nt, Artificial Sequence; identical to SEQ ID NO: 87522
  derived and/or modified sequence opt1 from hemagglutinin__InfluenzaB__AFJ80744

SEQ ID NO: 87796 - RNA, 1758 nt, Artificial Sequence; identical to SEQ ID NO: 87522
  derived and/or modified sequence opt1 from hemagglutinin__InfluenzaB__AFJ80755

SEQ ID NO: 87797 - RNA, 1758 nt, Artificial Sequence; identical to SEQ ID NO: 87522
  derived and/or modified sequence opt1 from hemagglutinin__InfluenzaB__AFJ80781

SEQ ID NO: 87798 - RNA, 1758 nt, Artificial Sequence; identical to SEQ ID NO: 87522
  derived and/or modified sequence opt1 from hemagglutinin__InfluenzaB__AFJ80792

SEQ ID NO: 87799 - RNA, 1758 nt, Artificial Sequence; identical to SEQ ID NO: 87522
  derived and/or modified sequence opt1 from hemagglutinin__InfluenzaB__AFJ80803

SEQ ID NO: 87800 - RNA, 1758 nt, Artificial Sequence; identical to SEQ ID NO: 87522
  derived and/or modified sequence opt1 from hemagglutinin__InfluenzaB__AFJ80814

SEQ ID NO: 87801 - RNA, 1758 nt, Artificial Sequence
  derived and/or modified sequence opt1 from hemagglutinin__InfluenzaB__AFJ80825
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccaucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgugacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 87802 - RNA, 1758 nt, Artificial Sequence; identical to SEQ ID NO: 87522
  derived and/or modified sequence opt1 from hemagglutinin__InfluenzaB__AFJ80836

SEQ ID NO: 87803 - RNA, 1758 nt, Artificial Sequence; identical to SEQ ID NO: 87590
  derived and/or modified sequence opt1 from hemagglutinin__InfluenzaB__AFJ80847

SEQ ID NO: 87804 - RNA, 1758 nt, Artificial Sequence; identical to SEQ ID NO: 87522
  derived and/or modified sequence opt1 from hemagglutinin__InfluenzaB__AFJ80858

SEQ ID NO: 87805 - RNA, 1758 nt, Artificial Sequence; identical to SEQ ID NO: 87522
  derived and/or modified sequence opt1 from hemagglutinin__InfluenzaB__AFJ80869

SEQ ID NO: 87806 - RNA, 1758 nt, Artificial Sequence; identical to SEQ ID NO: 87522
  derived and/or modified sequence opt1 from hemagglutinin__InfluenzaB__AFJ80880

SEQ ID NO: 87807 - RNA, 1758 nt, Artificial Sequence; identical to SEQ ID NO: 87573
  derived and/or modified sequence opt1 from hemagglutinin__InfluenzaB__AFJ80891

SEQ ID NO: 87808 - RNA, 1758 nt, Artificial Sequence; identical to SEQ ID NO: 87573
  derived and/or modified sequence opt1 from hemagglutinin__InfluenzaB__AFJ80902

SEQ ID NO: 87809 - RNA, 1758 nt, Artificial Sequence; identical to SEQ ID NO: 87522
  derived and/or modified sequence opt1 from hemagglutinin__InfluenzaB__AFJ80913

SEQ ID NO: 87810 - RNA, 1758 nt, Artificial Sequence
  derived and/or modified sequence opt1 from hemagglutinin__InfluenzaB__AFJ80924
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcgccgagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgcgacaacguguccugcagcaucugccuguga

SEQ ID NO: 87811 - RNA, 1758 nt, Artificial Sequence; identical to SEQ ID NO: 87573
  derived and/or modified sequence opt1 from hemagglutinin__InfluenzaB__AFJ80935

SEQ ID NO: 87812 - RNA, 1755 nt, Artificial Sequence; identical to SEQ ID NO: 87434
  derived and/or modified sequence opt1 from hemagglutinin__InfluenzaB__AFJ80946

SEQ ID NO: 87813 - RNA, 1758 nt, Artificial Sequence
  derived and/or modified sequence opt1 from hemagglutinin__InfluenzaB__AFJ80957
augaaggccaucaucgugcugcucauggucgccaccagcaacgcggaccgcaucugcaccggcaucacguccagcaacagcccccacguggugaagaccgccacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaacaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgcggagaacgccccgggcgggcccuacaagaucggcaccuccgggagcugccccaacgugacgaacggcaacggcuucuucgccaccauggccugggcgguccccaagaacgacaacaacaagaccgccaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggcggacugccugcacgagaaguacggcgggcugaacaaguccaagcccuacuacaccggcgagcacgccaaggccaucggcaacugccccaucugggugaagacgccgcucaagcuggccaacgggaccaaguaccgcccgcccgccaagcugcucaaggagcggggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccguggagaucgggaacggcugcuucgagaccaagcacaagugcaaccagaccugccuggaccggaucgccgcggggaccuucaacgccggcgaguucagccuccccacguucgacucccugaacaucaccgccgccagccugaacgacgacggccucgacaaccacaccauccugcuguacuacuccaccgccgcgagcucccuggccgucacgcucaugaucgccaucuucgugguguacauggucagccgcgacaacguguccugcagcaucugccuguga

SEQ ID NO: 87814 - RNA, 1755 nt, Artificial Sequence; identical to SEQ ID NO: 87434
  derived and/or modified sequence opt1 from hemagglutinin__InfluenzaB__AFJ80968

SEQ ID NO: 87815 - RNA, 1755 nt, Artificial Sequence; identical to SEQ ID NO: 87434
  derived and/or modified sequence opt1 from hemagglutinin__InfluenzaB__AFJ80979

SEQ ID NO: 87816 - RNA, 1755 nt, Artificial Sequence
  derived and/or modified sequence opt1 from hemagglutinin__InfluenzaB__AFJ80990
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccgaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccaacaaguccggcuucuucgccaccauggcgugggccguccccaaggacaacaacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccgcaguccgggcgcaucgucguggacuacaugaugcagaagcccggcaagacggggaccaucguguaccagcggggcguccugcugccccagaagguguggugcgccagcggccgcuccaaggugaucaaggggagccucccccugaucggcgaggcggacugccugcacgagaaguacgggggccucaacaagagcaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 87817 - RNA, 1755 nt, Artificial Sequence; identical to SEQ ID NO: 87434
  derived and/or modified sequence opt1 from hemagglutinin__InfluenzaB__AFJ81001

SEQ ID NO: 87818 - RNA, 1755 nt, Artificial Sequence; identical to SEQ ID NO: 87434
  derived and/or modified sequence opt1 from hemagglutinin__InfluenzaB__AFJ84360

SEQ ID NO: 87819 - RNA, 1758 nt, Artificial Sequence; identical to SEQ ID NO: 87522
  derived and/or modified sequence opt1 from hemagglutinin__InfluenzaB__AFJ90395

SEQ ID NO: 87820 - RNA, 1755 nt, Artificial Sequence; identical to SEQ ID NO: 87434
  derived and/or modified sequence opt1 from hemagglutinin__InfluenzaB__AFJ90406

SEQ ID NO: 87821 - RNA, 1755 nt, Artificial Sequence; identical to SEQ ID NO: 87434
  derived and/or modified sequence opt1 from hemagglutinin__InfluenzaB__AFJ90417

SEQ ID NO: 87822 - RNA, 1755 nt, Artificial Sequence; identical to SEQ ID NO: 87434
  derived and/or modified sequence opt1 from hemagglutinin__InfluenzaB__AFJ90428

SEQ ID NO: 87823 - RNA, 1755 nt, Artificial Sequence; identical to SEQ ID NO: 87434
  derived and/or modified sequence opt1 from hemagglutinin__InfluenzaB__AFJ90450

SEQ ID NO: 87824 - RNA, 1755 nt, Artificial Sequence; identical to SEQ ID NO: 87434
  derived and/or modified sequence opt1 from hemagglutinin__InfluenzaB__AFJ91038

SEQ ID NO: 87825 - RNA, 1755 nt, Artificial Sequence
  derived and/or modified sequence opt1 from hemagglutinin__InfluenzaB__AFJ91049
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaucacccccaccaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcuggcgaaccuccugcggggguacgagaacauccgccugagcacccagaacgugaucgacgccgagaaggcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 87826 - RNA, 1758 nt, Artificial Sequence
  derived and/or modified sequence opt1 from hemagglutinin__InfluenzaB__AFJ91060
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugcccccgcugccugaacugcaccgaccuggacguggcccucgggcggcccaagugcaccggcaacaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgggacaacguguccugcagcaucugccuguga

SEQ ID NO: 87827 - RNA, 1755 nt, Artificial Sequence; identical to SEQ ID NO: 87434
  derived and/or modified sequence opt1 from hemagglutinin__InfluenzaB__AFJ91071

SEQ ID NO: 87828 - RNA, 1755 nt, Artificial Sequence
  derived and/or modified sequence opt1 from hemagglutinin__InfluenzaB__AFJ91082
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 87829 - RNA, 1755 nt, Artificial Sequence; identical to SEQ ID NO: 87828
  derived and/or modified sequence opt1 from hemagglutinin__InfluenzaB__AFJ91093

SEQ ID NO: 87830 - RNA, 1755 nt, Artificial Sequence; identical to SEQ ID NO: 87828
  derived and/or modified sequence opt1 from hemagglutinin__InfluenzaB__AFJ91104

SEQ ID NO: 87831 - RNA, 1755 nt, Artificial Sequence; identical to SEQ ID NO: 87828
  derived and/or modified sequence opt1 from hemagglutinin__InfluenzaB__AFJ91115

SEQ ID NO: 87832 - RNA, 1758 nt, Artificial Sequence
  derived and/or modified sequence opt1 from hemagglutinin__InfluenzaB__AFJ91704
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaagggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87833 - RNA, 1755 nt, Artificial Sequence
  derived and/or modified sequence opt1 from hemagglutinin__InfluenzaB__AFK09797
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaucaaguccuacuucgccaaccugaaggggaccaagacgcggggcaagcucugccccgacugccugaacugcaccgaccuggacguggcccucgggcgccccaugugcgugggcaccaccccguccgccaaggccagcauccugcacgagguccggcccgugacguccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcaccuccgggagcugccccaacgccacguccaagagcggcuucuucgccaccauggcgugggccguccccaaggacaacaacaagaacgccaccaacccgcugaccguggaggugcccuacgucugcacggagggcgaggaccagaucaccguguggggguuccacuccgacaacaagaaccagaugaagaaccuguacggcgacagcaacccccagaaguucaccuccagcgccaacggggugaccacgcacuacgucucccagaucggcggcuuccccgaccagaccgaggacgggggccucccgcagagcgggcggaucgugguggacuacaugguccagaagcccggcaagaccgggaccaucguguaccagcgcggcgugcugcugccccagaaggucuggugcgccuccggccggagcaaggugaucaaggggagccucccccugaucggcgaggcggacugccugcacgagaaguacgggggccucaacaaguccaagccguacuacacgggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagacgugccucgaccggaucgccgcgggcaccuucaacgccggggaguucagccugcccaccuucgacucccugaacaucaccgccgccagccucaacgacgacggccuggacaaccacaccauccugcuguacuacuccacggccgcgagcucccucgccgugacccugaugcuggccaucuucaucguguacauggucagccgcgacaacguguccugcagcaucugccucuga

SEQ ID NO: 87834 - RNA, 1755 nt, Artificial Sequence; identical to SEQ ID NO: 87828
  derived and/or modified sequence opt1 from hemagglutinin__InfluenzaB__AFN54654

SEQ ID NO: 87835 - RNA, 1755 nt, Artificial Sequence; identical to SEQ ID NO: 87575
  derived and/or modified sequence opt1 from hemagglutinin__InfluenzaB__AFN54665

SEQ ID NO: 87836 - RNA, 1755 nt, Artificial Sequence; identical to SEQ ID NO: 87575
  derived and/or modified sequence opt1 from hemagglutinin__InfluenzaB__AFN54676

SEQ ID NO: 87837 - RNA, 1755 nt, Artificial Sequence; identical to SEQ ID NO: 87828
  derived and/or modified sequence opt1 from hemagglutinin__InfluenzaB__AFN54687

SEQ ID NO: 87838 - RNA, 1755 nt, Artificial Sequence
  derived and/or modified sequence opt1 from hemagglutinin__InfluenzaB__AFN54698
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuucgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 87839 - RNA, 1755 nt, Artificial Sequence; identical to SEQ ID NO: 87828
  derived and/or modified sequence opt1 from hemagglutinin__InfluenzaB__AFN54709

SEQ ID NO: 87840 - RNA, 1755 nt, Artificial Sequence; identical to SEQ ID NO: 87828
  derived and/or modified sequence opt1 from hemagglutinin__InfluenzaB__AFN54720

SEQ ID NO: 87841 - RNA, 1755 nt, Artificial Sequence; identical to SEQ ID NO: 87828
  derived and/or modified sequence opt1 from hemagglutinin__InfluenzaB__AFN54731

SEQ ID NO: 87842 - RNA, 1755 nt, Artificial Sequence; identical to SEQ ID NO: 87828
  derived and/or modified sequence opt1 from hemagglutinin__InfluenzaB__AFN54742

SEQ ID NO: 87843 - RNA, 1755 nt, Artificial Sequence; identical to SEQ ID NO: 87828
  derived and/or modified sequence opt1 from hemagglutinin__InfluenzaB__AFN54753

SEQ ID NO: 87844 - RNA, 1755 nt, Artificial Sequence; identical to SEQ ID NO: 87828
  derived and/or modified sequence opt1 from hemagglutinin__InfluenzaB__AFN54764

SEQ ID NO: 87845 - RNA, 1755 nt, Artificial Sequence; identical to SEQ ID NO: 87828
  derived and/or modified sequence opt1 from hemagglutinin__InfluenzaB__AFN54775

SEQ ID NO: 87846 - RNA, 1755 nt, Artificial Sequence; identical to SEQ ID NO: 87828
  derived and/or modified sequence opt1 from hemagglutinin__InfluenzaB__AFN54786

SEQ ID NO: 87847 - RNA, 1755 nt, Artificial Sequence; identical to SEQ ID NO: 87828
  derived and/or modified sequence opt1 from hemagglutinin__InfluenzaB__AFN54797

SEQ ID NO: 87848 - RNA, 1755 nt, Artificial Sequence; identical to SEQ ID NO: 87828
  derived and/or modified sequence opt1 from hemagglutinin__InfluenzaB__AFN54808

SEQ ID NO: 87849 - RNA, 1755 nt, Artificial Sequence; identical to SEQ ID NO: 87575
  derived and/or modified sequence opt1 from hemagglutinin__InfluenzaB__AFN54819

SEQ ID NO: 87850 - RNA, 1755 nt, Artificial Sequence; identical to SEQ ID NO: 87828
  derived and/or modified sequence opt1 from hemagglutinin__InfluenzaB__AFN54830

SEQ ID NO: 87851 - RNA, 1755 nt, Artificial Sequence; identical to SEQ ID NO: 87828
  derived and/or modified sequence opt1 from hemagglutinin__InfluenzaB__AFN54841

SEQ ID NO: 87852 - RNA, 1755 nt, Artificial Sequence; identical to SEQ ID NO: 87828
  derived and/or modified sequence opt1 from hemagglutinin__InfluenzaB__AFN54852

SEQ ID NO: 87853 - RNA, 1755 nt, Artificial Sequence; identical to SEQ ID NO: 87828
  derived and/or modified sequence opt1 from hemagglutinin__InfluenzaB__AFN54863

SEQ ID NO: 87854 - RNA, 1758 nt, Artificial Sequence
  derived and/or modified sequence opt1 from hemagglutinin__InfluenzaB__AFU34595
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuaccgggacagcaagccccagaaguucacguccagcgccaacggggugaccacccacuacgugucccagaucggcggcuucccgaaccagaccgaggacgggggccugccccagagcgggcgcaucgucguggacuacauggugcagaaguccggcaagacggggaccaucaccuaccagcggggcauccugcucccccagaaggucuggugcgccagcggccgcuccaaggugaucaaggggagccugccccugaucggcgaggccgacugccuccacgagaaguacgggggccugaacaagagcaagccguacuacaccggggagcacgcgaaggccaucggcaacugccccaucugggugaagacgccccugaagcucgccaacggcaccaaguaccggcccccgaccaagcugcugaaggagcgcggguucuucggcgccaucgccggguuccucgagggcgggugggagggcaugaucgcgggcuggcacggguacaccucccacggcgcccacggggucgccguggccgccgaccugaaguccacgcaggaggcgaucaacaagaucaccaagaaccugaacucccucagcgagcuggaggucaagaaccugcagcggcucuccggcgccauggacgagcugcacaacgagauccuggagcucgacgagaagguggacgaccugcgcgccgacaccaucagcucccagaucgagcuggccgugcuccugagcaacgagggcaucaucaacuccgaggacgagcaccuccuggcccuggagcggaagcugaagaagaugcucgggcccagcgcggucgagaucggcaacgggugcuucgagaccaagcacaagugcaaccagaccugccuggaccgcaucgccgccggcacguucgacgccggggaguucucccugcccaccuucgacagccucaacaucaccgcggccucccugaacgacgacggccuggacaaccacaccauccuccuguacuacagcacggccgccuccagccuggccgugacccugaugaucgcgaucuucguggucuacauggugucccgggacaacgugagcugcuccaucugccucuga

SEQ ID NO: 87855 - RNA, 1758 nt, Artificial Sequence
  derived and/or modified sequence opt1 from hemagglutinin__InfluenzaB__AFU34606
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggaccgcccgaagugcaccgggaagauccccuccgcccgggugagcauccuccacgagguccgccuggugacguccggcugcuuccccaucaugcacgaccggaccaagauccgccagcugcccaaccuccugcggggcuacgagcacauccgccugagcacccacaacgugaucaacgccgagaacgcgcccgggggccccuacaagaucgggaccuccggcagcugccccaacgucacgaacgggaacggcuucuucgccaccauggccugggccgugcccaagaacgacaagaacaagaccgcgaccaacccgcucacgaucgaggugcccuacaucugcaccgagggcgaggaccagaucaccgucuggggguuccacuccgacgacgagacccagauggccaagcuguacggcgacagcaagccccagaaguucacguccagcgccaacggggugaccacccacuacgugucccagaucggcggcuuccccaaccagaccgaggacgggggccugccgcagagcgggcggaucgucguggacuacauggugcagaaguccggcaagacggggaccaucaccuaccagcgcggcauccuccugccccagaaggucuggugcgccagcggccgguccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggccgagcgccgucgagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87856 - RNA, 1758 nt, Artificial Sequence; identical to SEQ ID NO: 87764
  derived and/or modified sequence opt1 from hemagglutinin__InfluenzaB__AFU34617

SEQ ID NO: 87857 - RNA, 1758 nt, Artificial Sequence
  derived and/or modified sequence opt1 from hemagglutinin__InfluenzaB__AFU34628
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacgacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuuccucggggccaucgcgggcuuccuggagggcggguggaagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87858 - RNA, 1758 nt, Artificial Sequence; identical to SEQ ID NO: 87616
  derived and/or modified sequence opt1 from hemagglutinin__InfluenzaB__AFU34639

SEQ ID NO: 87859 - RNA, 1758 nt, Artificial Sequence; identical to SEQ ID NO: 87653
  derived and/or modified sequence opt1 from hemagglutinin__InfluenzaB__AGB08299

SEQ ID NO: 87860 - RNA, 1758 nt, Artificial Sequence; identical to SEQ ID NO: 87653
  derived and/or modified sequence opt1 from hemagglutinin__InfluenzaB__AGB08300

SEQ ID NO: 87861 - RNA, 1755 nt, Artificial Sequence
  derived and/or modified sequence opt1 from hemagglutinin__InfluenzaB__AGB97259
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacaucgugagccgggacaacguguccugcagcaucugccucuga

SEQ ID NO: 87862 - RNA, 1755 nt, Artificial Sequence
  derived and/or modified sequence opt1 from hemagglutinin__InfluenzaB__AGB97265
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87863 - RNA, 1755 nt, Artificial Sequence; identical to SEQ ID NO: 87862
  derived and/or modified sequence opt1 from hemagglutinin__InfluenzaB__AGF44878

SEQ ID NO: 87864 - RNA, 1755 nt, Artificial Sequence; identical to SEQ ID NO: 87862
  derived and/or modified sequence opt1 from hemagglutinin__InfluenzaB__AGF44879

SEQ ID NO: 87865 - RNA, 1755 nt, Artificial Sequence
  derived and/or modified sequence opt1 from hemagglutinin__InfluenzaB__AGF44881
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcgcuggagcgcaagcugaagaagaugcuggggcccuccgccguggacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugauccugaugcuggcgaucuucaucgucuacauggugagccgcgacaacguguccugcagcaucugccucuga

SEQ ID NO: 87866 - RNA, 1755 nt, Artificial Sequence
  derived and/or modified sequence opt1 from hemagglutinin__InfluenzaB__AGF44882
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggcaagagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagacgaagcacaagugcaaccagaccugccucgaccgcaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgggacaacguguccugcagcaucugccucuga

SEQ ID NO: 87867 - RNA, 1755 nt, Artificial Sequence; identical to SEQ ID NO: 87862
  derived and/or modified sequence opt1 from hemagglutinin__InfluenzaB__AGF44883

SEQ ID NO: 87868 - RNA, 1755 nt, Artificial Sequence; identical to SEQ ID NO: 87862
  derived and/or modified sequence opt1 from hemagglutinin__InfluenzaB__AGF44884

SEQ ID NO: 87869 - RNA, 1755 nt, Artificial Sequence; identical to SEQ ID NO: 87862
  derived and/or modified sequence opt1 from hemagglutinin__InfluenzaB__AGF44886

SEQ ID NO: 87870 - RNA, 1755 nt, Artificial Sequence; identical to SEQ ID NO: 87862
  derived and/or modified sequence opt1 from hemagglutinin__InfluenzaB__AGF44887

SEQ ID NO: 87871 - RNA, 1755 nt, Artificial Sequence; identical to SEQ ID NO: 87862
  derived and/or modified sequence opt1 from hemagglutinin__InfluenzaB__AGF44888

SEQ ID NO: 87872 - RNA, 1755 nt, Artificial Sequence
  derived and/or modified sequence opt1 from hemagglutinin__InfluenzaB__AGL09834
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcgcuggagcgcaagcugaagaagaugcuggggcccuccgccguggacaucggcaacgggugcuucgagaccaagcacaagugcaaccagacgugccucgaccggaucgccgccggcaccuucaacgccggggacuucagccugcccaccuucgacucccugaacaucaccgcggccagccucaacgacgacggccuggacaaccacaccauccugcuguacuacuccacggccgccagcucccucgccgugacccugaugcuggcgaucuucaucgucuacauggugagccgcgacaacguguccugcagcaucugccucuga

SEQ ID NO: 87873 - RNA, 1755 nt, Artificial Sequence; identical to SEQ ID NO: 87862
  derived and/or modified sequence opt1 from hemagglutinin__InfluenzaB__AGL09835

SEQ ID NO: 87874 - RNA, 1755 nt, Artificial Sequence
  derived and/or modified sequence opt1 from hemagglutinin__InfluenzaB__AGL09836
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccaagaaggcccccggcgggccguaccgccucggcacguccgggagcugccccaacgccaccuccaagagcggcuucuucgcgaccauggccugggccguccccgaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87875 - RNA, 1755 nt, Artificial Sequence; identical to SEQ ID NO: 87862
  derived and/or modified sequence opt1 from hemagglutinin__InfluenzaB__AGL09837

SEQ ID NO: 87876 - RNA, 1755 nt, Artificial Sequence; identical to SEQ ID NO: 87862
  derived and/or modified sequence opt1 from hemagglutinin__InfluenzaB__AGL09838

SEQ ID NO: 87877 - RNA, 1755 nt, Artificial Sequence; identical to SEQ ID NO: 87862
  derived and/or modified sequence opt1 from hemagglutinin__InfluenzaB__AGL09839

SEQ ID NO: 87878 - RNA, 1755 nt, Artificial Sequence; identical to SEQ ID NO: 87862
  derived and/or modified sequence opt1 from hemagglutinin__InfluenzaB__AGL09840

SEQ ID NO: 87879 - RNA, 1755 nt, Artificial Sequence; identical to SEQ ID NO: 87862
  derived and/or modified sequence opt1 from hemagglutinin__InfluenzaB__AGL09841

SEQ ID NO: 87880 - RNA, 1758 nt, Artificial Sequence
  derived and/or modified sequence opt1 from hemagglutinin__InfluenzaB__AGL09842
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgagaccaacccgcucacgaucgaggugcccuacaucugcaccgagggggaggaccagaucaccgucuggggcuuccacuccgacaacgagacccagauggcgaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 87881 - RNA, 1755 nt, Artificial Sequence; identical to SEQ ID NO: 87862
  derived and/or modified sequence opt1 from hemagglutinin__InfluenzaB__AGL09843

SEQ ID NO: 87882 - RNA, 1755 nt, Artificial Sequence
  derived and/or modified sequence opt1 from hemagglutinin__InfluenzaB__AGL09844
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaaggaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagaccaagcacaagugcaaccagacgugccucgaccggaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacauggugagccgcgacaacguguccugcagcaucugccucuga

SEQ ID NO: 87883 - RNA, 1755 nt, Artificial Sequence; identical to SEQ ID NO: 87862
  derived and/or modified sequence opt1 from hemagglutinin__InfluenzaB__AGL09845

SEQ ID NO: 87884 - RNA, 1755 nt, Artificial Sequence; identical to SEQ ID NO: 87862
  derived and/or modified sequence opt1 from hemagglutinin__InfluenzaB__AGL09846

SEQ ID NO: 87885 - RNA, 1755 nt, Artificial Sequence
  derived and/or modified sequence opt1 from hemagglutinin__InfluenzaB__AGL09847
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcgaucuggggguuccacuccgacaacaagacccagaugaagaaccuguacggcgacagcaacccccagaaguucaccuccagcgccaacggggucaccacgcacuacgugucccagaucggcggcuuccccgaccagaccgaggacgggggccucccccagagcgggcggaucguggucgacuacaugaugcagaagccgggcaagaccgggaccaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggugaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacggggucgccguggccgccgaccucaaguccacccaggaggcgaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugacccugaugcuggcgaucuucaucguguacauggucagccgcgacaacguguccugcagcaucugccucuga

SEQ ID NO: 87886 - RNA, 1755 nt, Artificial Sequence
  derived and/or modified sequence opt1 from hemagglutinin__InfluenzaB__AGL09849
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucaacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87887 - RNA, 1755 nt, Artificial Sequence; identical to SEQ ID NO: 87862
  derived and/or modified sequence opt1 from hemagglutinin__InfluenzaB__AGL09850

SEQ ID NO: 87888 - RNA, 1755 nt, Artificial Sequence; identical to SEQ ID NO: 87862
  derived and/or modified sequence opt1 from hemagglutinin__InfluenzaB__AGL09851

SEQ ID NO: 87889 - RNA, 1758 nt, Artificial Sequence; identical to SEQ ID NO: 87653
  derived and/or modified sequence opt1 from hemagglutinin__InfluenzaB__AGL09852

SEQ ID NO: 87890 - RNA, 1755 nt, Artificial Sequence; identical to SEQ ID NO: 87862
  derived and/or modified sequence opt1 from hemagglutinin__InfluenzaB__AGL09853

SEQ ID NO: 87891 - RNA, 1755 nt, Artificial Sequence; identical to SEQ ID NO: 87862
  derived and/or modified sequence opt1 from hemagglutinin__InfluenzaB__AGL09854

SEQ ID NO: 87892 - RNA, 1758 nt, Artificial Sequence
  derived and/or modified sequence opt1 from hemagglutinin__InfluenzaB__AGL09855
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgagaccaacccgcucacgaucgaggugcccuacaucugcaccgaggaggaggaccagaucaccgucuggggguuccacuccgacaacgagacccagauggcgaagcuguacggcgacagcaagccccagaaguucacguccagcgccaacggggugaccacccacuacgugucccagaucggcgacuuccccaaccagaccgaggacggcgggcugccgcagagcggccggaucgucguggacuacauggugcagaaguccgggaagacgggcaccaucaccuaccagcgcgggauccuccugccccagaaggucuggugcgccagcggccgguccaaggugaucaagggcagccugccccucaucggggaggccgacugccugcacgagaaguacggcgggcugaacaagagcaagcccuacuacaccggcgagcacgccaaggcgaucgggaacugcccgaucugggugaagacgccccucaagcuggccaacggcaccaaguaccgcccgcccgccaagcugcucaaggagcggggcuucuucggggccaucgccggcuuccuggagggcgggugggaggggaugaucgcgggcuggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggggccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacgggcucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 87893 - RNA, 1755 nt, Artificial Sequence; identical to SEQ ID NO: 87862
  derived and/or modified sequence opt1 from hemagglutinin__InfluenzaB__AGL09856

SEQ ID NO: 87894 - RNA, 1755 nt, Artificial Sequence
  derived and/or modified sequence opt1 from hemagglutinin__InfluenzaB__AGL09857
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaaggugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugauccagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87895 - RNA, 1758 nt, Artificial Sequence
  derived and/or modified sequence opt1 from hemagglutinin__InfluenzaB__AGL09859
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 87896 - RNA, 1758 nt, Artificial Sequence; identical to SEQ ID NO: 87895
  derived and/or modified sequence opt1 from hemagglutinin__InfluenzaB__AGL09860

SEQ ID NO: 87897 - RNA, 1758 nt, Artificial Sequence; identical to SEQ ID NO: 87895
  derived and/or modified sequence opt1 from hemagglutinin__InfluenzaB__AGL09861

SEQ ID NO: 87898 - RNA, 1758 nt, Artificial Sequence; identical to SEQ ID NO: 87895
  derived and/or modified sequence opt1 from hemagglutinin__InfluenzaB__AGL09862

SEQ ID NO: 87899 - RNA, 1758 nt, Artificial Sequence; identical to SEQ ID NO: 87895
  derived and/or modified sequence opt1 from hemagglutinin__InfluenzaB__AGL09863

SEQ ID NO: 87900 - RNA, 1755 nt, Artificial Sequence; identical to SEQ ID NO: 87862
  derived and/or modified sequence opt1 from hemagglutinin__InfluenzaB__AGL09864

SEQ ID NO: 87901 - RNA, 1755 nt, Artificial Sequence; identical to SEQ ID NO: 87862
  derived and/or modified sequence opt1 from hemagglutinin__InfluenzaB__AGL09866

SEQ ID NO: 87902 - RNA, 1755 nt, Artificial Sequence; identical to SEQ ID NO: 87862
  derived and/or modified sequence opt1 from hemagglutinin__InfluenzaB__AGL09867

SEQ ID NO: 87903 - RNA, 1755 nt, Artificial Sequence; identical to SEQ ID NO: 87862
  derived and/or modified sequence opt1 from hemagglutinin__InfluenzaB__AGL09868

SEQ ID NO: 87904 - RNA, 1755 nt, Artificial Sequence
  derived and/or modified sequence opt1 from hemagglutinin__InfluenzaB__AGL09869
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacaccaccuccaagagcggcuucuucgccaccauggcgugggccguccccaaggacaacaacaagaacgccacgaacccccugaccguggaggugccguacaucugcgccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcggaucgucguggacuacaugaugcagaagccgggcaagacggggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccucuga

SEQ ID NO: 87905 - RNA, 1755 nt, Artificial Sequence
  derived and/or modified sequence opt1 from hemagglutinin__InfluenzaB__AGL09870
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagcgguucaccuccagcgcgaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagacgaagcacaagugcaaccagaccugccucgaccgcaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgggacaacguguccugcagcaucugccucuga

SEQ ID NO: 87906 - RNA, 1755 nt, Artificial Sequence; identical to SEQ ID NO: 87862
  derived and/or modified sequence opt1 from hemagglutinin__InfluenzaB__AGL09871

SEQ ID NO: 87907 - RNA, 1755 nt, Artificial Sequence
  derived and/or modified sequence opt1 from hemagglutinin__InfluenzaB__AGL09872
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcgcuggagcgcaagcugaagaagaugcuggggcccuccgccguggacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugacccugaugcuggcgaucuucaucgucuacauggugagccgcgacaacguguccugcagcaucugccucuga

SEQ ID NO: 87908 - RNA, 1755 nt, Artificial Sequence; identical to SEQ ID NO: 87862
  derived and/or modified sequence opt1 from hemagglutinin__InfluenzaB__AGL09873

SEQ ID NO: 87909 - RNA, 1758 nt, Artificial Sequence; identical to SEQ ID NO: 87895
  derived and/or modified sequence opt1 from hemagglutinin__InfluenzaB__AGL09874

SEQ ID NO: 87910 - RNA, 1758 nt, Artificial Sequence; identical to SEQ ID NO: 87880
  derived and/or modified sequence opt1 from hemagglutinin__InfluenzaB__AGO02695

SEQ ID NO: 87911 - RNA, 1755 nt, Artificial Sequence; identical to SEQ ID NO: 87862
  derived and/or modified sequence opt1 from hemagglutinin__InfluenzaB__AGQ16249

SEQ ID NO: 87912 - RNA, 1758 nt, Artificial Sequence; identical to SEQ ID NO: 87895
  derived and/or modified sequence opt1 from hemagglutinin__InfluenzaB__AGQ16250

SEQ ID NO: 87913 - RNA, 1758 nt, Artificial Sequence; identical to SEQ ID NO: 87895
  derived and/or modified sequence opt1 from hemagglutinin__InfluenzaB__AGQ16251

SEQ ID NO: 87914 - RNA, 1755 nt, Artificial Sequence
  derived and/or modified sequence opt1 from hemagglutinin__InfluenzaB__AGQ16252
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgccacguccaagaucggcuucuucgcgaccauggccugggccguccccaaggacaacuacaagaacgccaccaacccgcugaccguggaggugcccuacaucugcaaggagggcgaggaccagaucacggucuggggguuccacagcgacaacaagacccagaugaagaaccuguacggcgacuccaacccccagaaguucaccagcuccgccaacggggugaccacgcacuacgugagccagaucggcgacuuccccgaccagaccgaggacggcgggcucccgcaguccggccgcaucgucguggacuacaugaugcagaagcccgggaagaccggcaccaucguguaccagcgcgggguccugcugccccagaagguguggugcgcgagcggccgguccaaggugaucaagggcagccucccccugaucggggaggccgacugccugcacgaggaguacggcgggcucaacaagagcaagccguacuacacgggcaagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagacgugccucgaccgcaucgcggccgggaccuucaacgccggcgaguucucccugcccaccuucgacagccugaacaucaccgccgccucccucaacgacgacgggcuggacaaccacaccauccugcuguacuacagcacggcggccuccagccucgccgugacccugaugcuggccaucuucaucgucuacauggugucccgggacaacgugagcugcuccaucugccucuga

SEQ ID NO: 87915 - RNA, 1755 nt, Artificial Sequence; identical to SEQ ID NO: 87862
  derived and/or modified sequence opt1 from hemagglutinin__InfluenzaB__AGQ16253

SEQ ID NO: 87916 - RNA, 1755 nt, Artificial Sequence
  derived and/or modified sequence opt1 from hemagglutinin__InfluenzaB__AGQ16255
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacgggaucacgacccacuacgugucccagaucggcggcuuccccgaccagaccgaggacgggggccucccccagagcgggcggaucguggucgacuacaugaugcagaagccgggcaagaccgggacgaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacggggucgccguggccgccgaccucaaguccacccaggaggccaucaacaagaucaccaagaaccugaacagccuguccgagcucgaggucaagaaccugcagcgccugagcggcgcgauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcggucgacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacaucauccugcuguacuacuccacggccgccagcucccucgccgugacccugaugcuggccaucuucaucguguacauggucagccgcgacaacguguccugcagcaucugccucuga

SEQ ID NO: 87917 - RNA, 1755 nt, Artificial Sequence
  derived and/or modified sequence opt1 from hemagglutinin__InfluenzaB__AGQ16256
augaaggccaucaucgugcugcucauggucgugaccagcaacgccgaccgcaucugcaccggcaucacguccagcaacagcccccacguggucaagaccgugacccagggggaggugaacgucaccggcgugaucccgcugacgaccacccccaccaaguccuacuucgcgaaccugaaggggacgaagacccggggcaagcucugccccgacugccugaacugcaccgaccuggacguggcccucgggcgccccaugugcgucggcaccacgccguccgccaaggccagcauccugcacgaggugcggcccgugaccuccggcugcuuccccaucaugcacgaccgcaccaagauccggcagcuggccaaccuccugcgcggguacgagaacauccggcugagcacccagaacgucaucgacgcggagaaggcccccggcgggccguaccgccucggcacguccgggagcugccccaacgccaccuccaagagcggcuucuucgccaccauggcgugggccgugcccaaggacuccaacaagaacgccaccaacccccugacgguggaggucccguacaucugcgccgagggcgaggaccagaucaccguguggggguuccacagcgacaacaagacccagaugaagaaccuguacggcgacuccaacccccagaaguucaccagcuccgccaacggggugacgacccacuacgucagccagaucggcggcuuccccgaccagaccgaggacgggggccucccccaguccgggcggaucgugguggacuacaugaugcagaagccgggcaagaccgggacgaucgucuaccagcgcggcgugcugcugccccagaagguguggugcgcgagcggccggagcaaggucaucaaggggucccucccccugaucggcgaggccgacugccugcacgagaaguacgggggccucaacaagagcaagcccuacuacaccggggagcacgccaaggccaucggcaacugcccgaucugggugaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccucccacggcgcccacggggucgcgguggccgccgaccucaagagcacccaggaggccaucaacaagaucaccaagaaccugaacucccugagcgagcucgaggugaagaaccugcagcgccuguccggcgccauggacgagcuccacaacgagauccuggagcuggacgagaaggucgacgaccuccgggcggacaccaucagcucccagaucgagcuggccgugcugcucagcaacgagggcaucaucaacuccgaggacgagcaccuccuggcccuggagcgcaagcugaagaagaugcuggggcccagcgccguggacaucggcaacgggugcuucgagacgaagcacaagugcaaccagaccugccucgaccggaucgcggccggcaccuucaacgccggggaguucucccugcccaccuucgacagccugaacaucaccgccgccucccucaacgacgacggccuggacaaccacacgauccugcuguacuacagcaccgcggccuccagccucgccgucacccugaugcuggccaucuucaucguguacauggugucccgcgacaacgucagcugcagcaucugccucuga

SEQ ID NO: 87918 - RNA, 1755 nt, Artificial Sequence; identical to SEQ ID NO: 87862
  derived and/or modified sequence opt1 from hemagglutinin__InfluenzaB__AGQ16257

SEQ ID NO: 87919 - RNA, 1755 nt, Artificial Sequence; identical to SEQ ID NO: 87862
  derived and/or modified sequence opt1 from hemagglutinin__InfluenzaB__AGQ16258

SEQ ID NO: 87920 - RNA, 1755 nt, Artificial Sequence; identical to SEQ ID NO: 87862
  derived and/or modified sequence opt1 from hemagglutinin__InfluenzaB__AGQ16259

SEQ ID NO: 87921 - RNA, 1755 nt, Artificial Sequence
  derived and/or modified sequence opt1 from hemagglutinin__InfluenzaB__AGQ16260
augaagaccaucaucgugcugcucauggucgugaccagcaacgccgaccgcaucugcacgggcaucaccuccagcaacagcccccacguggucaagaccgccacccagggggaggugaacgugacgggcgucaucccgcugaccaccacccccaccaaguccuacuucgcgaaccugaaggggaccaagacccggggcaagcucugccccgacugccugaacugcaccgaccuggacguggcccucgggcgccccaugugcgugggcacgaccccguccgccaaggccagcauccugcacgagguccggcccgugaccuccggcugcuuccccaucaugcacgaccgcaccaagauccggcagcuggccaaccuccugcgcggguacgagaacauccggcugagcucccagaacgugaucgacgcggagaaggcccccggcgggccguaccgccucggcacgagcggguccugccccaacgccaccagcaaguccggcuucuucgccaccauggcgugggccguccccaaggacaacaacaagaacgccaccaacccccugacgguggaggugccguacaucugcgccgagggcgaggaccagaucaccgucuggggguuccacagcgacaacaagacccagaugaagaaccuguacggcgacuccaacccccagaaguucaccagcuccgccaacggggugacgacccacuacgugagccagaucggcggcuuccccgaccagaccgaggacgggggccucccccaguccgggcggaucgucguggacuacaugaugcagaagccgggcaagaccgggacgaucguguaccagcgcggcguccugcugccccagaagguguggugcgcgagcggccggagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacacgucccacggcgcccacgggguggcggucgccgccgaccucaagagcacccaggaggccaucaacaagaucaccaagaaccugaacucccugagcgagcucgaggugaagaaccugcagcgccuguccggcgccauggacgagcuccacaacgagauccuggagcuggacgagaagguggacgaccuccgggcggacaccaucagcucccagaucgagcuggccguccugcucagcaacgagggcaucaucaacuccgaggacgagcaccuccuggcccuggagcgcaagcugaagaagaugcuggggcccagcgccguggacaucggcaacgggugcuucgagacgaagcacaagugcaaccagaccugccucgaccggaucgcggccggcaccuucaacgccggggaguucucccugcccaccuucgacagccugaacaucaccgccgccucccucaacgacgacggccuggacaaccacacgauccugcuguacuacagcaccgcggccuccagccucgccgugacccugaugcuggccaucuucaucgucuacauggugucccgcgacaacgugagcugcagcaucugccucuga

SEQ ID NO: 87922 - RNA, 1755 nt, Artificial Sequence; identical to SEQ ID NO: 87862
  derived and/or modified sequence opt1 from hemagglutinin__InfluenzaB__AGQ16261

SEQ ID NO: 87923 - RNA, 1755 nt, Artificial Sequence; identical to SEQ ID NO: 87862
  derived and/or modified sequence opt1 from hemagglutinin__InfluenzaB__AGQ16262

SEQ ID NO: 87924 - RNA, 1758 nt, Artificial Sequence; identical to SEQ ID NO: 87895
  derived and/or modified sequence opt1 from hemagglutinin__InfluenzaB__AGQ16263

SEQ ID NO: 87925 - RNA, 1758 nt, Artificial Sequence; identical to SEQ ID NO: 87895
  derived and/or modified sequence opt1 from hemagglutinin__InfluenzaB__AGQ16264

SEQ ID NO: 87926 - RNA, 1755 nt, Artificial Sequence; identical to SEQ ID NO: 87907
  derived and/or modified sequence opt1 from hemagglutinin__InfluenzaB__AGQ16265

SEQ ID NO: 87927 - RNA, 1755 nt, Artificial Sequence
  derived and/or modified sequence opt1 from hemagglutinin__InfluenzaB__AGQ16266
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccaggucggcggcuuccccgaccagaccgaggacgggggccucccccagagcgggcggaucgugguggacuacaugaugcagaagccgggcaagaccgggacgaucgucuaccagcgcggcgugcugcugccccagaagguguggugcgccuccggccggagcaaggucaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacggggucgccguggccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgucacccugaugcuggccaucuucaucguguacauggugagccgcgacaacgucuccugcagcaucugccucuga

SEQ ID NO: 87928 - RNA, 1755 nt, Artificial Sequence; identical to SEQ ID NO: 87907
  derived and/or modified sequence opt1 from hemagglutinin__InfluenzaB__AGQ16267

SEQ ID NO: 87929 - RNA, 1755 nt, Artificial Sequence; identical to SEQ ID NO: 87907
  derived and/or modified sequence opt1 from hemagglutinin__InfluenzaB__AGQ16268

SEQ ID NO: 87930 - RNA, 1758 nt, Artificial Sequence; identical to SEQ ID NO: 87880
  derived and/or modified sequence opt1 from hemagglutinin__InfluenzaB__AGQ16269

SEQ ID NO: 87931 - RNA, 1755 nt, Artificial Sequence; identical to SEQ ID NO: 87907
  derived and/or modified sequence opt1 from hemagglutinin__InfluenzaB__AGQ16270

SEQ ID NO: 87932 - RNA, 1755 nt, Artificial Sequence
  derived and/or modified sequence opt1 from hemagglutinin__InfluenzaB__AGQ16272
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccgucccccgggacaacaacaagaacgccaccaacccccugacgguggaggugccguacaucugcgaggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 87933 - RNA, 1755 nt, Artificial Sequence; identical to SEQ ID NO: 87862
  derived and/or modified sequence opt1 from hemagglutinin__InfluenzaB__AGQ16273

SEQ ID NO: 87934 - RNA, 1755 nt, Artificial Sequence; identical to SEQ ID NO: 87862
  derived and/or modified sequence opt1 from hemagglutinin__InfluenzaB__AGQ16274

SEQ ID NO: 87935 - RNA, 1755 nt, Artificial Sequence; identical to SEQ ID NO: 87862
  derived and/or modified sequence opt1 from hemagglutinin__InfluenzaB__AGQ16275

SEQ ID NO: 87936 - RNA, 1755 nt, Artificial Sequence; identical to SEQ ID NO: 87862
  derived and/or modified sequence opt1 from hemagglutinin__InfluenzaB__AGQ16276

SEQ ID NO: 87937 - RNA, 1755 nt, Artificial Sequence; identical to SEQ ID NO: 87907
  derived and/or modified sequence opt1 from hemagglutinin__InfluenzaB__AGQ16277

SEQ ID NO: 87938 - RNA, 1755 nt, Artificial Sequence; identical to SEQ ID NO: 87907
  derived and/or modified sequence opt1 from hemagglutinin__InfluenzaB__AGQ16278

SEQ ID NO: 87939 - RNA, 1755 nt, Artificial Sequence; identical to SEQ ID NO: 87907
  derived and/or modified sequence opt1 from hemagglutinin__InfluenzaB__AGQ16279

SEQ ID NO: 87940 - RNA, 1755 nt, Artificial Sequence; identical to SEQ ID NO: 87907
  derived and/or modified sequence opt1 from hemagglutinin__InfluenzaB__AGQ16280

SEQ ID NO: 87941 - RNA, 1755 nt, Artificial Sequence
  derived and/or modified sequence opt1 from hemagglutinin__InfluenzaB__AGQ16281
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcagcuuccccgaccagaccgaggacggcgggcucccccaguccggccggaucgucguggacuacaugaugcagaagccggggaagaccggcacgaucguguaccagcgcgggguccugcugccccagaagguguggugcgccagcggccggagcaaggugaucaagggcucccucccccugaucggggaggccgacugccugcacgagaaguacggcgggcucaacaagagcaagcccuacuacaccggcgagcacgccaaggccaucgggaacugcccgaucugggucaagacgccccugaagcuggcgaacggcaccaaguaccgcccgcccgccaagcuccugaaggagcggggcuucuucggggccaucgccggcuuccuggagggcgggugggaggggaugaucgccggcuggcacggcuacaccucccacggggcgcacggcguggccgucgccgccgaccucaagagcacccaggaggccaucaacaagaucaccaagaaccugaacucccugagcgagcucgaggugaagaaccugcagcgccuguccggggcgauggacgagcuccacaacgagauccuggagcuggacgagaagguggacgaccuccgggccgacaccaucagcucccagaucgagcuggccguccugcucagcaacgagggcaucaucaacuccgaggacgagcaccuccuggcccuggagcgcaagcugaagaagaugcugggccccagcgcgguggacaucgggaacggcugcuucgagacgaagcacaagugcaaccagaccugccucgaccggaucgccgccgggaccuucaacgccggcgaguucucccugcccaccuucgacagccugaacaucaccgccgcgucccucaacgacgacgggcuggacaaccacacgauccugcuguacuacagcaccgccgccuccagccucgccgugacccugaugcuggccaucuucaucgucuacauggugucccgcgacaacgugagcugcagcaucugccucuga

SEQ ID NO: 87942 - RNA, 1755 nt, Artificial Sequence
  derived and/or modified sequence opt1 from hemagglutinin__InfluenzaB__AGQ16282
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaagggcaacaacaagaacgccaccaacccccugacgguggaggugccguacaucugcgccgagggggaggaccagaucaccgucuggggcuuccacuccgacaacaagacccagaugaagaaccuguacggggacagcaacccccagcgguucaccuccagcgcgaacggcgugacgacccacuacgugucccagaucggcggguuccccgaccagaccgaggacggcgggcucccccagagcggccgcaucgucguggacuacaugaugcagaagccggggaagaccggcacgaucguguaccagcggggcguccugcugccccagaagguguggugcgccuccgggcgcagcaaggugaucaagggcagccucccccugaucggggaggccgacugccugcacgagaaguacggcgggcucaacaaguccaagcccuacuacaccggcgagcacgccaaggccaucggcaacugcccgaucugggucaagacgccccugaagcuggcgaacgggaccaaguaccggccgcccgccaagcuccugaaggagcgcggcuucuucggggccaucgccggcuuccuggagggcgggugggagggcaugaucgccggguggcacggcuacaccagccacggggcgcacggcguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgaggggaucaucaacagcgaggacgagcaccuccuggcccuggagcggaagcugaagaagaugcugggccccuccgcgguggacaucgggaacggcugcuucgagacgaagcacaagugcaaccagaccugccucgaccgcaucgccgccgggaccuucaacgccggcgaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgggacaacguguccugcagcaucugccucuga

SEQ ID NO: 87943 - RNA, 1755 nt, Artificial Sequence
  derived and/or modified sequence opt1 from hemagglutinin__InfluenzaB__AGQ16283
augaaggccaucaucgugcugcucauggucgugaccagcaacgccgaccgcaucugcaccggcaucacguccagcaacagcccccacguggucaagaccgcgacccacggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcgcuggagcgcaagcugaagaagaugcuggggcccuccgccguggacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugacccugaugcuggcgaucuucaucgucuacauggugagccgcgacaacguguccugcagcaucugccucuga

SEQ ID NO: 87944 - RNA, 1758 nt, Artificial Sequence
  derived and/or modified sequence opt1 from hemagglutinin__InfluenzaB__AGQ16284
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgaggcccgccccgucacguccggcugcuuccccaucaugcacgaccggaccaagauccgccagcugcccaaccuccugcggggguacgagcacaucaagcugagcacccacaacgugaucaacgcggagaacgccccgggcgggcccuacaagaucggcaccuccgggagcugccccaacgugacgaacggcaacggcuucuucgccaccauggccugggcgguccccaagaacgacaagaacaagaccgccaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgcggugcugcugagcaacgaggggaucaucaacuccgaggacgagcaccuccuggcccuggagcggaagcucaagaagaugcugggccccagcgccguggagaucgggaacggcugcuucgagaccaagcacaagugcaaccagaccugccuggaccgcaucgccgcggggaccuucgacgccggcgaguucucccuccccacguucgacagccugaacaucaccgccgccucccugaacgacgacggccucgacaaccacaccauccugcuguacuacagcaccgccgcguccagccuggccgucacgcucaugaucgccaucuucgugguguacauggucucccgggacaacgugagcugcuccaucugccuguga

SEQ ID NO: 87945 - RNA, 1755 nt, Artificial Sequence; identical to SEQ ID NO: 87907
  derived and/or modified sequence opt1 from hemagglutinin__InfluenzaB__AGQ16285

SEQ ID NO: 87946 - RNA, 1755 nt, Artificial Sequence; identical to SEQ ID NO: 87907
  derived and/or modified sequence opt1 from hemagglutinin__InfluenzaB__AGQ16286

SEQ ID NO: 87947 - RNA, 1755 nt, Artificial Sequence
  derived and/or modified sequence opt1 from hemagglutinin__InfluenzaB__AGQ16287
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgaggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagacgaagcacaagugcaaccagaccugccucgaccggaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgcgacaacguguccugcagcaucugccucuga

SEQ ID NO: 87948 - RNA, 1755 nt, Artificial Sequence; identical to SEQ ID NO: 87862
  derived and/or modified sequence opt1 from hemagglutinin__InfluenzaB__AGQ16289

SEQ ID NO: 87949 - RNA, 1755 nt, Artificial Sequence; identical to SEQ ID NO: 87862
  derived and/or modified sequence opt1 from hemagglutinin__InfluenzaB__AGQ16290

SEQ ID NO: 87950 - RNA, 1755 nt, Artificial Sequence
  derived and/or modified sequence opt1 from hemagglutinin__InfluenzaB__AGQ16291
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacaccaccuccaagagcggcuucuucgccaccauggcgugggccguccccaaggacaacaacaagaacgccacgaacccccugaccguggaggugccguacaucugcgccgagggcgaggaccagaucgccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 87951 - RNA, 1755 nt, Artificial Sequence
  derived and/or modified sequence opt1 from hemagglutinin__InfluenzaB__AGQ16292
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgagaucaagaaccugcagcgccugagcggcgccauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugacccugaugcuggcgaucuucaucguguacauggucagccgcgacaacguguccugcagcaucugccucuga

SEQ ID NO: 87952 - RNA, 1755 nt, Artificial Sequence; identical to SEQ ID NO: 87951
  derived and/or modified sequence opt1 from hemagglutinin__InfluenzaB__AGQ16293

SEQ ID NO: 87953 - RNA, 1755 nt, Artificial Sequence; identical to SEQ ID NO: 87951
  derived and/or modified sequence opt1 from hemagglutinin__InfluenzaB__AGQ16294

SEQ ID NO: 87954 - RNA, 1758 nt, Artificial Sequence
  derived and/or modified sequence opt1 from hemagglutinin__InfluenzaB__AGQ16295
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgcggagaacgccccgggcgggcccuacaagaucggcaccuccgggagcugccccaacgugacgaacggcaacggcuucuucgccaccauggccugggcgguccccaagaacgacaagaacaagaccgagaccaacccgcucacgaucgaggugcccuacaucugcaccgaggaggaggaccagaucaccguguggggguuccacuccgacaacgagacccagauggccaagcuguacggcgacagcaagccccagaaguucacguccagcgccaacggggucaccacccacuacgugucccagaucggcggcuuccccaaccagaccgaggacgggggccugccgcagagcgggcggaucguggucgacuacauggugcagaaguccggcaagacggggaccaucaccuaccagcgcggcauccuccugccccagaagguguggugcgccagcggccgguccaaggucaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacgggguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccguggagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 87955 - RNA, 1758 nt, Artificial Sequence; identical to SEQ ID NO: 87895
  derived and/or modified sequence opt1 from hemagglutinin__InfluenzaB__AGQ16296

SEQ ID NO: 87956 - RNA, 1755 nt, Artificial Sequence; identical to SEQ ID NO: 87862
  derived and/or modified sequence opt1 from hemagglutinin__InfluenzaB__AGQ16297

SEQ ID NO: 87957 - RNA, 1755 nt, Artificial Sequence
  derived and/or modified sequence opt1 from hemagglutinin__InfluenzaB__AGQ16298
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccaucgccgccgaccucaaguccacccaggaggccaucaacaagaucaccaagaaccugaacagccuguccgagcucgaggucaagaaccugcagcgccugagcggcgcgauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcggucgacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucguguacauggucagccgcgacaacguguccugcagcaucugccucuga

SEQ ID NO: 87958 - RNA, 1755 nt, Artificial Sequence; identical to SEQ ID NO: 87907
  derived and/or modified sequence opt1 from hemagglutinin__InfluenzaB__AGQ16299

SEQ ID NO: 87959 - RNA, 1755 nt, Artificial Sequence; identical to SEQ ID NO: 87907
  derived and/or modified sequence opt1 from hemagglutinin__InfluenzaB__AGQ16300

SEQ ID NO: 87960 - RNA, 1755 nt, Artificial Sequence; identical to SEQ ID NO: 87862
  derived and/or modified sequence opt1 from hemagglutinin__InfluenzaB__AGQ16301

SEQ ID NO: 87961 - RNA, 1755 nt, Artificial Sequence; identical to SEQ ID NO: 87862
  derived and/or modified sequence opt1 from hemagglutinin__InfluenzaB__AGQ16302

SEQ ID NO: 87962 - RNA, 1755 nt, Artificial Sequence; identical to SEQ ID NO: 87862
  derived and/or modified sequence opt1 from hemagglutinin__InfluenzaB__AGQ16303

SEQ ID NO: 87963 - RNA, 1755 nt, Artificial Sequence; identical to SEQ ID NO: 87862
  derived and/or modified sequence opt1 from hemagglutinin__InfluenzaB__AGQ16305

SEQ ID NO: 87964 - RNA, 1758 nt, Artificial Sequence
  derived and/or modified sequence opt1 from hemagglutinin__InfluenzaB__AGQ16306
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgagaccaacccgcucacgaucgaggugcccuacaucugcaaggagggggaggaccagaucaccgucuggggcuuccacuccgacaacgagacccagauggcgaagcuguacggggacagcaagccccagaaguucaccuccagcgccaacggcgugacgacccacuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccaccuucgacagccugaacaucacggcggccucccugaacgacgacggccucgacaaccacaccauccugcuguacuacagcaccgccgccuccagccuggccgugacccucaugaucgcgaucuucguggucuacauggugucccgcgacaacgugagcugcuccaucugccuguga

SEQ ID NO: 87965 - RNA, 1755 nt, Artificial Sequence; identical to SEQ ID NO: 87862
  derived and/or modified sequence opt1 from hemagglutinin__InfluenzaB__AGQ16307

SEQ ID NO: 87966 - RNA, 1758 nt, Artificial Sequence; identical to SEQ ID NO: 87895
  derived and/or modified sequence opt1 from hemagglutinin__InfluenzaB__AGQ16308

SEQ ID NO: 87967 - RNA, 1755 nt, Artificial Sequence
  derived and/or modified sequence opt1 from hemagglutinin__InfluenzaB__AGQ16309
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucgccgacuacaugaugcagaagccgggcaagaccgggacgaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacaccggggagcacgccaaggcgaucggcaacugcccgaucugggugaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacggggucgccguggccgccgaccucaaguccacccaggaggcgaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaacgggugcuucgagacgaagcacaagugcaaccagaccugccucgaccggaucgccgccggcaccuucaacgccggggaguucagccugcccaccuucgacucccugaacaucaccgcggccagccucaacgacgacggccuggacaaccacacgauccugcuguacuacuccaccgccgccagcucccucgccgugacccugaugcuggcgaucuucaucguguacauggucagccgcgacaacguguccugcagcaucugccucuga

SEQ ID NO: 87968 - RNA, 1755 nt, Artificial Sequence
  derived and/or modified sequence opt1 from hemagglutinin__InfluenzaB__AGQ16310
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugguggccggcuggcacggguacaccagccacggcgcgcacggggucgccguggccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgucacccugaugcuggccaucuucaucguguacauggugagccgcgacaacgucuccugcagcaucugccucuga

SEQ ID NO: 87969 - RNA, 1758 nt, Artificial Sequence; identical to SEQ ID NO: 87895
  derived and/or modified sequence opt1 from hemagglutinin__InfluenzaB__AGQ16311

SEQ ID NO: 87970 - RNA, 1755 nt, Artificial Sequence; identical to SEQ ID NO: 87862
  derived and/or modified sequence opt1 from hemagglutinin__InfluenzaB__AGQ16312

SEQ ID NO: 87971 - RNA, 1755 nt, Artificial Sequence
  derived and/or modified sequence opt1 from hemagglutinin__InfluenzaB__AGQ16313
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucgcggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagaagggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcgcuggagcggaagcugaagaagaugcuggggcccuccgccguggacaucggcaacgggugcuucgagaccaagcacaagugcaaccagacgugccucgaccgcaucgccgccggcaccuucaacgccggggaguucagccugcccaccuucgacucccugaacaucaccgcggccagccucaacgacgacggccuggacaaccacaccauccugcuguacuacuccacggccgccagcucccucgccgugacccugaugcuggcgaucuucaucgucuacauggugagccgggacaacguguccugcagcaucugccucuga

SEQ ID NO: 87972 - RNA, 1758 nt, Artificial Sequence
  derived and/or modified sequence opt1 from hemagglutinin__InfluenzaB__AGQ16314
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgagaccaacccgcucacgaucgaggugcccuacaucugcaccgaggaggaggaccagaucaccgucuggggguuccacuccgacaacgagacccagauggcgaagcuguacggcgacagcaagccccagaaguucacguccagcgccaacggggugaccacccacuacgugucccagaucggcggcuuccccaaccagaccgaggacgggggccugccgcagagcgggcggaucgucguggacuacauggugcagaaguccggcaagacggggaccaucaccuaccagcgcggcauccuccugccccagaaggucuggugcgccagcggccgguccaaggugaucaaggggagccugccccucaucggcgaggccgacugccugcacgagaaguacgggggccugaacaagagcaagcccuacuacaccggggagcacgccaaggcgaucggcaacugcccgaucugggugaagacgccccucaagcuggccaacggcaccaaguaccgcccgcccgccaagcugcucaaggagcggggguucuucggcgccaucgccggguuccuggagggcgggugggagggcaugaucgcgggcuggcacggguacaccucccacggcgcccacggggucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcccuggagcgcaagcucaagaagaugcuggggcccagcgcggucgagaucggcaacgggugcuucgagaccaagcacaagugcaaccagaccugccuggaccggaucgccgccggcaccuucgacgccggggaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 87973 - RNA, 1755 nt, Artificial Sequence
  derived and/or modified sequence opt1 from hemagglutinin__InfluenzaB__AGQ16315
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagacggugaucgacgccgagaaggcccccggcgggccguaccgccucggcaccuccgggagcugccccaacgccaccuccaagagcggcuucuucgcgaccauggccugggccguccccaaggacaacaacaagaacgccacgaacccccugaccguggaggugccguacaucugcgccgagggcgaggaccagaucaccgucuggggguuccacuccgacaacaagacccagaugaagaaccuguacggcgacagcaacccccagaaguucacguccagcgcgaacgggaucaccacccacuacgugucccagaucggcggcuuccccgaccagaccgaggacgggggccucccccagagcgggcggaucguggucgacuacaugaugcagaagccgggcaagacggggaccaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacggggucgccguggccgccgaccucaaguccacccaggaggccaucaacaagaucaccaagaaccugaacagccuguccgagcucgaggucaagaaccugcagcgccugagcggcgcgauggacgagcuccacaacgagauccuggagcuggacgagaagguggacgaccuccgggccgacacgaucuccagccagaucgagcuggccgugcugcucuccaacgagggcaucaucaacagcgaggacgagcaccuccuggcccuggagcgcaagcugaagaagaugcuggggcccuccgcggucgacaucggcaacgggugcuucgagaccaagcacaagugcaaccagaccugccucgaccggaucgccgccggcaccuucaacgccggggaguucagccugcccaccuucgacucccugaacaucacggccgcgagccucaacgacgacggccuggacaaccacaucauccugcuguacuacuccaccgccgccagcucccucgccgugacccugaugcuggccaucuucaucguguacauggucagccgcgacaacguguccugcagcaucugccucuga

SEQ ID NO: 87974 - RNA, 1755 nt, Artificial Sequence; identical to SEQ ID NO: 87862
  derived and/or modified sequence opt1 from hemagglutinin__InfluenzaB__AGQ16316

SEQ ID NO: 87975 - RNA, 1755 nt, Artificial Sequence; identical to SEQ ID NO: 87862
  derived and/or modified sequence opt1 from hemagglutinin__InfluenzaB__AGQ16317

SEQ ID NO: 87976 - RNA, 1758 nt, Artificial Sequence; identical to SEQ ID NO: 87653
  derived and/or modified sequence opt1 from hemagglutinin__InfluenzaB__AGQ16318

SEQ ID NO: 87977 - RNA, 1755 nt, Artificial Sequence
  derived and/or modified sequence opt1 from hemagglutinin__InfluenzaB__AGQ16319
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgggugccugaacugcaccgaccuggacguggcccucggccgccccaugugcgugggcaccacgccguccgccaaggccagcauccugcacgagguccggcccgugaccuccgggugcuuccccaucaugcacgaccgcaccaagauccggcagcuggcgaaccuccugcgcggcuacgagaacauccggcugagcacccagaacgugaucgacgccgagaaggcccccgggggcccguaccgccucgggacguccggcagcugccccaacgccaccuccaagagcggcuucuucgcgaccauggccugggccguccccaaggacaacaacaagaacgccaccaacccccugacgguggaggugccguacaucugcgccgagggggaggaccagaucgcggucuggggcuuccacuccgacaacaagacccagaugaagaaccuguacggggacagcaacccccagaaguucaccuccagcgccaacggcgugaccacgcacuacgugucccagaucggcggguuccccgaccagaccgaggacggcgggcucccccagagcggccggaucgucguggacuacaugaugcagaagccggggaagaccggcaccaucguguaccagcgcggcguccugcugccccagaagguguggugcgccuccgggcggagcaaggugaucaagggcagccucccccugaucggggaggccgacugccugcacgagaaguacggcgggcucaacaaguccaagcccuacuacacgggcgagcacgccaaggcgaucggcaacugcccgaucugggucaagacgccccugaagcuggccaacgggaccaaguaccgcccgcccgccaagcuccugaaggagcggggcuucuucggggccaucgccggcuuccuggagggcgggugggagggcaugaucgcgggguggcacggcuacaccagccacggggcccacggcguggccgucgccgccgaccucaaguccacccaggaggcgaucaacaagaucaccaagaaccugaacagccuguccgagcucgaggugaagaaccugcagcgccugagcggcgccauggacgagcuccacaacgagauccuggagcuggacgagaagguggacgaccuccgggccgacaccaucuccagccagaucgagcuggccguccugcucuccaacgaggggaucaucaacagcgaggacgagcaccuccuggcgcuggagcgcaagcugaagaagaugcugggccccuccgccguggacaucgggaacggcugcuucgagaccaagcacaagugcaaccagacgugccucgaccggaucgccgccgggaccuucaacgccggcgaguucagccugcccaccuucgacucccugaacaucaccgcggccagccucaacgacgacggccuggacaaccacaccauccugcuguacuacuccacggccgccagcucccucgccgugacccugaugcuggcgaucuucaucgucuacauggugagccgcgacaacguguccugcagcaucugccucuga

SEQ ID NO: 87978 - RNA, 1755 nt, Artificial Sequence; identical to SEQ ID NO: 87907
  derived and/or modified sequence opt1 from hemagglutinin__InfluenzaB__AGQ16320

SEQ ID NO: 87979 - RNA, 1755 nt, Artificial Sequence; identical to SEQ ID NO: 87862
  derived and/or modified sequence opt1 from hemagglutinin__InfluenzaB__AGQ16321

SEQ ID NO: 87980 - RNA, 1755 nt, Artificial Sequence; identical to SEQ ID NO: 87862
  derived and/or modified sequence opt1 from hemagglutinin__InfluenzaB__AGQ16322

SEQ ID NO: 87981 - RNA, 1758 nt, Artificial Sequence
  derived and/or modified sequence opt1 from hemagglutinin__InfluenzaB__AGQ16323
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccucccugaaggggacggagacccggggcaagcucugccccaagugccugaacugcaccgaccuggacguggcccucgggcgccccaagugcaccggcaagaucccgagcgcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgaggacgcgccgggcgggcccuacaagaucggcaccagcggguccugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccgcaguccggccggaucgucguggacuacauggugcagaaguccgggaagacgggcaccaucaccuaccagcgcggcauccuccugccccagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87982 - RNA, 1755 nt, Artificial Sequence; identical to SEQ ID NO: 87862
  derived and/or modified sequence opt1 from hemagglutinin__InfluenzaB__AGQ16324

SEQ ID NO: 87983 - RNA, 1755 nt, Artificial Sequence; identical to SEQ ID NO: 87862
  derived and/or modified sequence opt1 from hemagglutinin__InfluenzaB__AGQ16325

SEQ ID NO: 87984 - RNA, 1755 nt, Artificial Sequence; identical to SEQ ID NO: 87862
  derived and/or modified sequence opt1 from hemagglutinin__InfluenzaB__AGQ16326

SEQ ID NO: 87985 - RNA, 1755 nt, Artificial Sequence; identical to SEQ ID NO: 87862
  derived and/or modified sequence opt1 from hemagglutinin__InfluenzaB__AGQ16327

SEQ ID NO: 87986 - RNA, 1758 nt, Artificial Sequence
  derived and/or modified sequence opt1 from hemagglutinin__InfluenzaB__AGQ16328
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagacgccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacgucaccaacggcaacggcuucuucgccaccauggccugggccgugcccaagaacgacaagaacaagaccgcgacgaacccgcucaccaucgaggugcccuacaucugcaccgagggggaggaccagaucaccgucuggggcuuccacuccgacaacgagacgcagauggccaagcuguacggggacagcaacccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcuccaucugccuguga

SEQ ID NO: 87987 - RNA, 1758 nt, Artificial Sequence
  derived and/or modified sequence opt1 from hemagglutinin__InfluenzaB__AGX15487
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 87988 - RNA, 1758 nt, Artificial Sequence; identical to SEQ ID NO: 87987
  derived and/or modified sequence opt1 from hemagglutinin__InfluenzaB__AGX15496

SEQ ID NO: 87989 - RNA, 1758 nt, Artificial Sequence
  derived and/or modified sequence opt1 from hemagglutinin__InfluenzaB__AGX15518
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaagagccacuucgccaaccugaaggggaccaagacgcggggcaagcucugccccaagugccugaacugcaccgaccuggacguggcccucgggcgccccaagugcaccggcaacaucccguccgccgaggugagcauccugcacgagguccggcccgugaccuccggcugcuuccccaucaugcacgaccgcacgaagauccggcagcugcccaaccuccugcgcggguacgagcacauccggcugagcacccacaacgugaucaacgcggagaaggccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccaucuggggcuuccacagcgacaacgagacccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaagccggggaagaccggcacgaucaccuaccagcggggcauccuccugccccagaagguguggugcgccagcgggcgcuccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcggcuguccagcgccauggacgagcugcacaacgagauccucgagcuggacgagaaggucgacgaccugcgcgccgacacgaucuccagccagaucgagcucgcggugcugcuguccaacgagggcaucaucaacagcgaggacgagcaccuccuggcccuggagcggaagcucaagaagaugcuggggcccuccgccguggagaucggcaacgggugcuucgagaccaagcacaagugcaaccagaccugccuggaccgcaucgccgcgggcaccuucgacgccggggaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 87990 - RNA, 1758 nt, Artificial Sequence
  derived and/or modified sequence opt1 from hemagglutinin__InfluenzaB__AGX15529
augaaggccaucaucgugcugcucauggucgugaccagcaacgccgaccgcgugugcaccggcaucacguccagcaacagcccccacgucgugaagaccgcgacccagggggaggugaacgucaccggcgugaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggucagcauccuguacgaggugcggcccgugacguccggcugcuuccccaucaugcacgaccgcaccaagauccggcagcugcccaaccuccugcgcggguacgagcacauccggcugagcacccacaacgucaucaacgccgagaaggcgccgggcgggcccuacaagaucggcaccuccgggagcugccccaacgugacgaacggcaacggcuucuucgccaccauggccugggccgugcccaagaacgacaacaacaagaccgcgaccaacucccucacgaucgaggucccguacaucugcaccgagggggaggaccagaucaccaucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcacccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccucaagagcacgcaggaggccaucaacaagaucaccaagaaccugaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgggacaacgugagcugcuccaucugccuguga

SEQ ID NO: 87991 - RNA, 1758 nt, Artificial Sequence; identical to SEQ ID NO: 87581
  derived and/or modified sequence opt1 from hemagglutinin__InfluenzaB__AGX15541

SEQ ID NO: 87992 - RNA, 1758 nt, Artificial Sequence
  derived and/or modified sequence opt1 from hemagglutinin__InfluenzaB__AGX15552
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccaagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 87993 - RNA, 1758 nt, Artificial Sequence; identical to SEQ ID NO: 87590
  derived and/or modified sequence opt1 from hemagglutinin__InfluenzaB__AGX15563

SEQ ID NO: 87994 - RNA, 1758 nt, Artificial Sequence; identical to SEQ ID NO: 87590
  derived and/or modified sequence opt1 from hemagglutinin__InfluenzaB__AGX15574

SEQ ID NO: 87995 - RNA, 1758 nt, Artificial Sequence
  derived and/or modified sequence opt1 from hemagglutinin__InfluenzaB__AGX15607
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacacgccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacgucaccaacggcaacggcuucuucgccaccauggccugggccgugcccaagaacgacaacaacaagaccgcgacgaacucccucaccaucgaggugccguacaucugcaccgagggggaggaccagaucaccgucuggggcuuccacagcgacaacgagacgcagauggccaagcuguacggggacuccaagccccagaaguucaccagcuccgccaacggcgugaccacccacuacgugagccagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacgcaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggacguucgacgcgggcgaguucagccuccccaccuucgacucccugaacaucaccgccgccagccugaacgacgacggccucgacaaccacaccauccugcuguacuacuccacggccgccagcucccuggcggugacccucaugaucgccaucuucguggucuacauggugagccgcgacaacguguccugcagcaucugccuguga

SEQ ID NO: 87996 - RNA, 1758 nt, Artificial Sequence
  derived and/or modified sequence opt1 from hemagglutinin__InfluenzaB__AGX15629
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcaccuccgggcggagcaaggugaucaagggcagccugccccucaucggggaggccgacugccugcacgagaaguacggcgggcugaacaaguccaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacccaggaggcgaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcccuggagcgcaagcucaagaagaugcugggccccuccgcggucgagaucgggaacggcugcuucgagaccaagcacaagugcaaccagaccugccuggaccggaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucguggucuacauggugagccgcgacaacguguccugcagcaucugccuguga

SEQ ID NO: 87997 - RNA, 1758 nt, Artificial Sequence
  derived and/or modified sequence opt1 from hemagglutinin__InfluenzaB__AGX15651
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 87998 - RNA, 1758 nt, Artificial Sequence; identical to SEQ ID NO: 87997
  derived and/or modified sequence opt1 from hemagglutinin__InfluenzaB__AGX15675

SEQ ID NO: 87999 - RNA, 1758 nt, Artificial Sequence; identical to SEQ ID NO: 87997
  derived and/or modified sequence opt1 from hemagglutinin__InfluenzaB__AGX15686

SEQ ID NO: 88000 - RNA, 1758 nt, Artificial Sequence
  derived and/or modified sequence opt1 from hemagglutinin__InfluenzaB__AGX15697
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagaaccagauggccaagcuguacggggacagcaagccccagaaguucaccuccagcgccaacggcgucacgacccacuacgugucccagaucggcggguuccccaaccagaccgaggacggcgggcugccgcagagcggccggaucguggucgacuacauggugcagaaguccgggaagaccggcacgaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggucacccucaugaucgccaucuucgugguguacauggucucccgcgacaacgugagcugcuccaucugccuguga

SEQ ID NO: 88001 - RNA, 1758 nt, Artificial Sequence; identical to SEQ ID NO: 87997
  derived and/or modified sequence opt1 from hemagglutinin__InfluenzaB__AGX15708

SEQ ID NO: 88002 - RNA, 1758 nt, Artificial Sequence; identical to SEQ ID NO: 87997
  derived and/or modified sequence opt1 from hemagglutinin__InfluenzaB__AGX15719

SEQ ID NO: 88003 - RNA, 1758 nt, Artificial Sequence; identical to SEQ ID NO: 87522
  derived and/or modified sequence opt1 from hemagglutinin__InfluenzaB__AGX15730

SEQ ID NO: 88004 - RNA, 1758 nt, Artificial Sequence; identical to SEQ ID NO: 87997
  derived and/or modified sequence opt1 from hemagglutinin__InfluenzaB__AGX15741

SEQ ID NO: 88005 - RNA, 1758 nt, Artificial Sequence; identical to SEQ ID NO: 87997
  derived and/or modified sequence opt1 from hemagglutinin__InfluenzaB__AGX15753

SEQ ID NO: 88006 - RNA, 1758 nt, Artificial Sequence
  derived and/or modified sequence opt1 from hemagglutinin__InfluenzaB__AGX15764
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcgaucacgcucaugaucgccaucuucgucguguacauggugucccgcgacaacgucagcugcuccaucugccuguga

SEQ ID NO: 88007 - RNA, 1755 nt, Artificial Sequence
  derived and/or modified sequence opt1 from hemagglutinin__InfluenzaB__AGX15775
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagauccagaugaagaaccuguacggcgacagcaacccccagaaguucaccuccagcgccaacggggugacgacccacuacgugucccagaucggcagcuuccccgaccagaccgaggacggcgggcucccgcaguccggccgcaucgucguggacuacaugaugcagaagcccgggaagaccggcacgaucguguaccagcgcgggguccugcugccccagcgcguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacaccaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagacgaagcacaagugcaaccagaccugccucgaccggaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgcgacaacgugagcugcagcaucugccucuga

SEQ ID NO: 88008 - RNA, 1758 nt, Artificial Sequence
  derived and/or modified sequence opt1 from hemagglutinin__InfluenzaB__AGX15786
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucuuccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 88009 - RNA, 1758 nt, Artificial Sequence; identical to SEQ ID NO: 87997
  derived and/or modified sequence opt1 from hemagglutinin__InfluenzaB__AGX15797

SEQ ID NO: 88010 - RNA, 1758 nt, Artificial Sequence
  derived and/or modified sequence opt1 from hemagglutinin__InfluenzaB__AGX15808
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccaucgggcggagcaaggugaucaagggcucccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88011 - RNA, 1758 nt, Artificial Sequence; identical to SEQ ID NO: 87616
  derived and/or modified sequence opt1 from hemagglutinin__InfluenzaB__AGX15830

SEQ ID NO: 88012 - RNA, 1758 nt, Artificial Sequence; identical to SEQ ID NO: 87616
  derived and/or modified sequence opt1 from hemagglutinin__InfluenzaB__AGX15841

SEQ ID NO: 88013 - RNA, 1758 nt, Artificial Sequence; identical to SEQ ID NO: 87616
  derived and/or modified sequence opt1 from hemagglutinin__InfluenzaB__AGX15852

SEQ ID NO: 88014 - RNA, 1758 nt, Artificial Sequence; identical to SEQ ID NO: 87616
  derived and/or modified sequence opt1 from hemagglutinin__InfluenzaB__AGX15863

SEQ ID NO: 88015 - RNA, 1758 nt, Artificial Sequence
  derived and/or modified sequence opt1 from hemagglutinin__InfluenzaB__AGX15874
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccugaacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88016 - RNA, 1758 nt, Artificial Sequence; identical to SEQ ID NO: 87616
  derived and/or modified sequence opt1 from hemagglutinin__InfluenzaB__AGX15885

SEQ ID NO: 88017 - RNA, 1758 nt, Artificial Sequence
  derived and/or modified sequence opt1 from hemagglutinin__InfluenzaB__AGX15896
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccgcccacuacgugucccagaucggcggguucccgaaccagaccgaggacggcgggcugccccagagcggccggaucgucguggacuacauggugcagaaguccgggaagaccggcacgaucaccuaccagcgcggcauccugcucccccagaaggucuggugcgccagcgggcgguccaaggugaucaagggcagccugccccugaucggggaggcggacugccuccacgagaaguacggcgggcugaacaagagcaagccguacuacaccggcgagcacgccaaggccaucggcaacugccccaucugggugaagacgccccugaagcucgccaacgggaccaaguaccggcccccggccaagcugcugaaggagcgcggcuucuucggggcgaucgccggcuuccucgagggcgggugggagggcaugaucgccggguggcacggcuacaccucccacggggcccacggcgucgccguggcggccgaccugaaguccacccaggaggccaucaacaagaucaccaagaaccugaacucccucagcgagcuggaggucaagaaccugcagcgccucuccggcgccauggacgagcugcacggggagauccuggagcucgacgagaagguggacgaccugcgggccgacacgaucagcucccagaucgagcuggcggugcuccugagcaacgagggcaucaucaacuccgaggacgagcaccuccuggcccuggagcgcaagcugaagaagaugcucgggcccagcgccgucgagaucggcaacgggugcuucgagaccaagcacaagugcaaccagaccugccuggaccggaucgccgcgggcaccuucgacgccggcgaguucucccugcccaccuucgacagccucaacaucacggccgccucccugaacgacgacgggcuggacaaccacaccauccuccuguacuacagcaccgccgcguccagccuggccgugacccugaugaucgccaucuucguggucuacauggugucccgcgacaacgugagcugcuccaucugccucuga

SEQ ID NO: 88018 - RNA, 1758 nt, Artificial Sequence; identical to SEQ ID NO: 87616
  derived and/or modified sequence opt1 from hemagglutinin__InfluenzaB__AGX15907

SEQ ID NO: 88019 - RNA, 1758 nt, Artificial Sequence; identical to SEQ ID NO: 87616
  derived and/or modified sequence opt1 from hemagglutinin__InfluenzaB__AGX15918

SEQ ID NO: 88020 - RNA, 1758 nt, Artificial Sequence
  derived and/or modified sequence opt1 from hemagglutinin__InfluenzaB__AGX15929
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcaccaacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgagaagacggggaccaucaccuaccagcgcggcauccuccugccccagaaggucuggugcgccagcggccgguccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccgucgagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88021 - RNA, 1758 nt, Artificial Sequence; identical to SEQ ID NO: 87616
  derived and/or modified sequence opt1 from hemagglutinin__InfluenzaB__AGX15940

SEQ ID NO: 88022 - RNA, 1758 nt, Artificial Sequence
  derived and/or modified sequence opt1 from hemagglutinin__InfluenzaB__AGX15962
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugaugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88023 - RNA, 1758 nt, Artificial Sequence; identical to SEQ ID NO: 87653
  derived and/or modified sequence opt1 from hemagglutinin__InfluenzaB__AGX15973

SEQ ID NO: 88024 - RNA, 1758 nt, Artificial Sequence; identical to SEQ ID NO: 87653
  derived and/or modified sequence opt1 from hemagglutinin__InfluenzaB__AGX15984

SEQ ID NO: 88025 - RNA, 1758 nt, Artificial Sequence; identical to SEQ ID NO: 87691
  derived and/or modified sequence opt1 from hemagglutinin__InfluenzaB__AGX15995

SEQ ID NO: 88026 - RNA, 1758 nt, Artificial Sequence; identical to SEQ ID NO: 87691
  derived and/or modified sequence opt1 from hemagglutinin__InfluenzaB__AGX16006

SEQ ID NO: 88027 - RNA, 1758 nt, Artificial Sequence
  derived and/or modified sequence opt1 from hemagglutinin__InfluenzaB__AGX16017
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagauccagauggccaagcuguacggggacagcaagccccagaaguucaccuccagcgccaacggcgugacgacccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucgucguguacauggugucccgcgacaacgucagcugcuccaucugccuguga

SEQ ID NO: 88028 - RNA, 1755 nt, Artificial Sequence; identical to SEQ ID NO: 87434
  derived and/or modified sequence opt1 from hemagglutinin__InfluenzaB__AGX16028

SEQ ID NO: 88029 - RNA, 1755 nt, Artificial Sequence
  derived and/or modified sequence opt1 from hemagglutinin__InfluenzaB__AGX16039
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccguggacgagcuccacaacgagauccuggagcuggacgagaaggucgacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgucacccugaugcuggccaucuucaucguguacauggugagccgggacaacgucuccugcagcaucugccucuga

SEQ ID NO: 88030 - RNA, 1755 nt, Artificial Sequence
  derived and/or modified sequence opt1 from hemagglutinin__InfluenzaB__AGX16050
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgcccagaccgaggacgggggccucccgcagagcgggcgcaucgucguggacuacauggugcagaagccccggaagacgggcaccaucgucuaccagcgcggggugcugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcgucgcgguggccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugcuggccaucuucaucguguacauggugagccgcgacaacgucuccugcagcaucugccucuga

SEQ ID NO: 88031 - RNA, 1755 nt, Artificial Sequence
  derived and/or modified sequence opt1 from hemagglutinin__InfluenzaB__AGX16061
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88032 - RNA, 1755 nt, Artificial Sequence
  derived and/or modified sequence opt1 from hemagglutinin__InfluenzaB__AGX16083
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggagaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88033 - RNA, 1755 nt, Artificial Sequence
  derived and/or modified sequence opt1 from hemagglutinin__InfluenzaB__AGX16105
augaaggccaucaucgugcugcucauggucgugaccagcaacgccgaccgcaucugcaccggcaucacguccagcuccagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccgagcgccaaggccuccauccugcacgagguccgccccgugaccagcggcugcuuccccaucaugcacgaccggaccaagauccgccagcugcccaaccuccugcggggguacgagaacauccgccuguccacccagaacgugaucgacgcggagaaggccccgggcgggcccuaccggcucggcacgagcggguccugccccaacgccaccagcaaguccggcuucuucgccaccauggcgugggccguccccaaggacaacaacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccgcaguccgggcgcaucgucguggacuacaugaugcagaagcccggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacagcgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacgugagcugcuccaucugccucuga

SEQ ID NO: 88034 - RNA, 1755 nt, Artificial Sequence
  derived and/or modified sequence opt1 from hemagglutinin__InfluenzaB__AGX16116
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgcccagaccgaggacgggggccucccgcagagcgggcgcaucgugguggacuacaugguccagaagccccggaagacgggcaccaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgagaucaagaaccugcagcgccugagcggggccauggacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugcuggccaucuucaucguguacauggugagccgcgacaacgucuccugcagcaucugccucuga

SEQ ID NO: 88035 - RNA, 1755 nt, Artificial Sequence
  derived and/or modified sequence opt1 from hemagglutinin__InfluenzaB__AGX16127
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagauccagaugaagaaccuguacggcgacagcaacccccagaaguucaccuccagcgccaacggggugacgacccacuacgucucccagaucggcggcuuccccgcccagaccgaggacgggggccucccgcagagcgggcgcaucgugguggacuacaugguccagaagccccggaagaccggcacgaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgagaucaagaaccugcagcgccugagcggggccauggacgagcuccacaacgagauccuggagcuggacgagaaggucgacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagacgaagcacaagugcaaccagaccugccucgaccggaucgcggccgggaccuucaacgccggcgaguucagccugcccaccuucgacucccugaacaucaccgccgccagccucaacgacgacgggcuggacaaccacacgauccugcuguacuacuccaccgcggccagcucccucgccgucacccugaugcuggccaucuucaucguguacauggugagccgcgacaacgucuccugcagcaucugccucuga

SEQ ID NO: 88036 - RNA, 1755 nt, Artificial Sequence; identical to SEQ ID NO: 88034
  derived and/or modified sequence opt1 from hemagglutinin__InfluenzaB__AGX16138

SEQ ID NO: 88037 - RNA, 1755 nt, Artificial Sequence; identical to SEQ ID NO: 88031
  derived and/or modified sequence opt1 from hemagglutinin__InfluenzaB__AGX16149

SEQ ID NO: 88038 - RNA, 1755 nt, Artificial Sequence; identical to SEQ ID NO: 88032
  derived and/or modified sequence opt1 from hemagglutinin__InfluenzaB__AGX16160

SEQ ID NO: 88039 - RNA, 1755 nt, Artificial Sequence; identical to SEQ ID NO: 88032
  derived and/or modified sequence opt1 from hemagglutinin__InfluenzaB__AGX16182

SEQ ID NO: 88040 - RNA, 1755 nt, Artificial Sequence; identical to SEQ ID NO: 87434
  derived and/or modified sequence opt1 from hemagglutinin__InfluenzaB__AGX16193

SEQ ID NO: 88041 - RNA, 1755 nt, Artificial Sequence; identical to SEQ ID NO: 87434
  derived and/or modified sequence opt1 from hemagglutinin__InfluenzaB__AGX16215

SEQ ID NO: 88042 - RNA, 1755 nt, Artificial Sequence; identical to SEQ ID NO: 87434
  derived and/or modified sequence opt1 from hemagglutinin__InfluenzaB__AGX16226

SEQ ID NO: 88043 - RNA, 1755 nt, Artificial Sequence
  derived and/or modified sequence opt1 from hemagglutinin__InfluenzaB__AGX16237
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccaucacccugaugcuggccaucuucaucguguacauggucagccgggacaacguguccugcagcaucugccucuga

SEQ ID NO: 88044 - RNA, 1755 nt, Artificial Sequence; identical to SEQ ID NO: 87434
  derived and/or modified sequence opt1 from hemagglutinin__InfluenzaB__AGX16248

SEQ ID NO: 88045 - RNA, 1755 nt, Artificial Sequence; identical to SEQ ID NO: 87434
  derived and/or modified sequence opt1 from hemagglutinin__InfluenzaB__AGX16259

SEQ ID NO: 88046 - RNA, 1755 nt, Artificial Sequence
  derived and/or modified sequence opt1 from hemagglutinin__InfluenzaB__AGX16270
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88047 - RNA, 1755 nt, Artificial Sequence; identical to SEQ ID NO: 88046
  derived and/or modified sequence opt1 from hemagglutinin__InfluenzaB__AGX16281

SEQ ID NO: 88048 - RNA, 1755 nt, Artificial Sequence
  derived and/or modified sequence opt1 from hemagglutinin__InfluenzaB__AGX16292
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcaaccagaacgugaucgacgccgagaaggcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaagggggcccucccccugaucggcgaggccgacugccugcacgagaaguacgggggccucaacaagagcaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccucccacggcgcgcacgggguggccgucgccgccgaccucaagagcacccaggaggccaucaacaagaucaccaagaaccugaacucccugagcgagcucgaggugaagaaccugcagcggcuguccggcgcgauggacgagcuccacaacgagauccuggagcuggacgagaagguggacgaccuccgcgccgacaccaucagcucccagaucgagcuggccguccugcucagcaacgagggcaucaucaacuccgaggacgagcaccuccuggcccuggagcggaagcugaagaagaugcuggggcccagcgcgguggacaucggcaacgggugcuucgagacgaagcacaagugcaaccagaccugccucgaccgcaucgccgccggcaccuucaacgccggggaguucucccugcccaccuucgacagccugaacaucaccgccgcgucccucaacgacgacggccuggacaaccacacgauccugcuguacuacagcaccgccgccuccagccucgccgugacccugaugcuggccaucuucaucgucuacauggugucccgggacaacgugagcugcuccaucugccucuga

SEQ ID NO: 88049 - RNA, 1758 nt, Artificial Sequence; identical to SEQ ID NO: 87522
  derived and/or modified sequence opt1 from hemagglutinin__InfluenzaB__AGX16303

SEQ ID NO: 88050 - RNA, 1755 nt, Artificial Sequence; identical to SEQ ID NO: 87434
  derived and/or modified sequence opt1 from hemagglutinin__InfluenzaB__AGX16314

SEQ ID NO: 88051 - RNA, 1755 nt, Artificial Sequence; identical to SEQ ID NO: 87434
  derived and/or modified sequence opt1 from hemagglutinin__InfluenzaB__AGX16325

SEQ ID NO: 88052 - RNA, 1755 nt, Artificial Sequence; identical to SEQ ID NO: 87739
  derived and/or modified sequence opt1 from hemagglutinin__InfluenzaB__AGX16336

SEQ ID NO: 88053 - RNA, 1755 nt, Artificial Sequence; identical to SEQ ID NO: 87739
  derived and/or modified sequence opt1 from hemagglutinin__InfluenzaB__AGX16347

SEQ ID NO: 88054 - RNA, 1755 nt, Artificial Sequence; identical to SEQ ID NO: 87739
  derived and/or modified sequence opt1 from hemagglutinin__InfluenzaB__AGX16358

SEQ ID NO: 88055 - RNA, 1755 nt, Artificial Sequence
  derived and/or modified sequence opt1 from hemagglutinin__InfluenzaB__AGX16369
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgggggauccugcugccccagaaggucuggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcagcaucugccucuga

SEQ ID NO: 88056 - RNA, 1755 nt, Artificial Sequence
  derived and/or modified sequence opt1 from hemagglutinin__InfluenzaB__AGX16380
augaaggccaucgugguccugcucaugguggugaccagcaacgccgaccgcaucugcaccggcaucacguccagcaacagcccccacgucgugaagaccgcgacccagggggaggugaacgucaccggcgugaucccgcugacgaccacccccaccaaguccuacuucgccaaccugaaggggacgcggacccgcggcaagcucugccccgacugccugaacugcaccgaccuggacguggcccucgggcggcccaugugcgucggcgccaccccguccgccaaggcgagcauccugcacgaggugcgccccgugacguccggcugcuuccccaugaugcacgaccggaccaagauccgccagcugcccaaccuccugcggggguacgagaacauccgccugagcacccagaacgucaucgacgccgagaaggccccgggcgggcccuaccggcucggcaccuccgggagcugccccaacgccacguccaagagcggcuucuucgcgaccauggccugggccgugcccaaggacaacaacaagaacgccaccaacccgcugaccguggagguccccuacaucugcacggagggcgaggaccagaucaccguguggggguuccacuccgacaacaagacccagaugaagaaccuguacggcgacagcaacccccagaaguucaccuccagcgccaacggggugacgacccacuacgucucccagaucggcagcuuccccgaccagaccgaggacggcgggcucccgcaguccggccgcaucgugguggacuacaugaugcagaagcccgggaagaccggcacgaucgucuaccagcgcggggugcugcugccccagaagguguggugcgcgagcggccggagcaaggucaucaagggcucccucccccugaucggggaggccgacugccugcacgagaaguacggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcgucgcgguggccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaaggucgacgaccuccgcgcggacaccaucagcucccagaucgagcuggccgugcugcucagcaacgagggcaucaucaacuccgaggacgagcaccuccuggcccuggagcggaagcugaagaagaugcugggccccagcgccguggagaucgggaacggcugcuucgagacgaagcacaagugcaaccagaccugccucgaccgcaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgucacccugaugcuggccaucuucaucguguacauggugucccgggacaacgucagcugcagcaucugccucuga

SEQ ID NO: 88057 - RNA, 1755 nt, Artificial Sequence; identical to SEQ ID NO: 87575
  derived and/or modified sequence opt1 from hemagglutinin__InfluenzaB__AGX16391

SEQ ID NO: 88058 - RNA, 1755 nt, Artificial Sequence
  derived and/or modified sequence opt1 from hemagglutinin__InfluenzaB__AGX16402
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagccccagaugaagaaccuguacggcgacuccaacccccagaaguucaccagcuccgccaacggggugacgacccacuacgugagccagaucggcgacuucccggaccagaccgaggacggcgggcucccccaguccggccgcaucgucguggacuacaugaugcagaagcccgggaagaccggcacgaucguguaccagcgcgggguccugcugccccagaagguguggugcgccagcggccgguccaaggugaucaagggcagccucccgcugaucggggaggcggacugccugcacgagaaguacggcgggcucaacaagagcaagcccuacuacaccggcgagcacgccaaggccaucgggaacugccccaucugggucaagacgccccugaagcuggccaacggcaccaaguaccggccgcccgccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 88059 - RNA, 1755 nt, Artificial Sequence; identical to SEQ ID NO: 87828
  derived and/or modified sequence opt1 from hemagglutinin__InfluenzaB__AGX16413

SEQ ID NO: 88060 - RNA, 1755 nt, Artificial Sequence; identical to SEQ ID NO: 87828
  derived and/or modified sequence opt1 from hemagglutinin__InfluenzaB__AGX16423

SEQ ID NO: 88061 - RNA, 1755 nt, Artificial Sequence; identical to SEQ ID NO: 87828
  derived and/or modified sequence opt1 from hemagglutinin__InfluenzaB__AGX16434

SEQ ID NO: 88062 - RNA, 1755 nt, Artificial Sequence; identical to SEQ ID NO: 87828
  derived and/or modified sequence opt1 from hemagglutinin__InfluenzaB__AGX16445

SEQ ID NO: 88063 - RNA, 1755 nt, Artificial Sequence; identical to SEQ ID NO: 87828
  derived and/or modified sequence opt1 from hemagglutinin__InfluenzaB__AGX16456

SEQ ID NO: 88064 - RNA, 1755 nt, Artificial Sequence
  derived and/or modified sequence opt1 from hemagglutinin__InfluenzaB__AGX16467
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgcgggguccugcugccccagcgcguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 88065 - RNA, 1755 nt, Artificial Sequence; identical to SEQ ID NO: 87828
  derived and/or modified sequence opt1 from hemagglutinin__InfluenzaB__AGX16478

SEQ ID NO: 88066 - RNA, 1755 nt, Artificial Sequence; identical to SEQ ID NO: 87575
  derived and/or modified sequence opt1 from hemagglutinin__InfluenzaB__AGX16489

SEQ ID NO: 88067 - RNA, 1758 nt, Artificial Sequence; identical to SEQ ID NO: 87987
  derived and/or modified sequence opt1 from hemagglutinin__InfluenzaB__AGX16500

SEQ ID NO: 88068 - RNA, 1758 nt, Artificial Sequence; identical to SEQ ID NO: 87987
  derived and/or modified sequence opt1 from hemagglutinin__InfluenzaB__AGX16511

SEQ ID NO: 88069 - RNA, 1758 nt, Artificial Sequence; identical to SEQ ID NO: 87987
  derived and/or modified sequence opt1 from hemagglutinin__InfluenzaB__AGX16522

SEQ ID NO: 88070 - RNA, 1758 nt, Artificial Sequence
  derived and/or modified sequence opt1 from hemagglutinin__InfluenzaB__AGX16533
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaaggagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88071 - RNA, 1758 nt, Artificial Sequence
  derived and/or modified sequence opt1 from hemagglutinin__InfluenzaB__AGX16555
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgggacaacguguccugcagcaucugccuguga

SEQ ID NO: 88072 - RNA, 1758 nt, Artificial Sequence
  derived and/or modified sequence opt1 from hemagglutinin__InfluenzaB__AGX16566
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88073 - RNA, 1758 nt, Artificial Sequence; identical to SEQ ID NO: 87987
  derived and/or modified sequence opt1 from hemagglutinin__InfluenzaB__AGX16577

SEQ ID NO: 88074 - RNA, 1758 nt, Artificial Sequence
  derived and/or modified sequence opt1 from hemagglutinin__InfluenzaB__AGX16588
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggucacccucaugaucgccaucuucgugguguacauggucagccgggacaacguguccugcagcaucugccuguga

SEQ ID NO: 88075 - RNA, 1758 nt, Artificial Sequence; identical to SEQ ID NO: 87987
  derived and/or modified sequence opt1 from hemagglutinin__InfluenzaB__AGX16599

SEQ ID NO: 88076 - RNA, 1758 nt, Artificial Sequence; identical to SEQ ID NO: 88070
  derived and/or modified sequence opt1 from hemagglutinin__InfluenzaB__AGX16610

SEQ ID NO: 88077 - RNA, 1758 nt, Artificial Sequence; identical to SEQ ID NO: 87987
  derived and/or modified sequence opt1 from hemagglutinin__InfluenzaB__AGX16621

SEQ ID NO: 88078 - RNA, 1758 nt, Artificial Sequence
  derived and/or modified sequence opt1 from hemagglutinin__InfluenzaB__AGX16654
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaucaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggucacccucaugaucgccaucuucgugguguacauggucagccgggacaacguguccugcagcaucugccuguga

SEQ ID NO: 88079 - RNA, 1758 nt, Artificial Sequence; identical to SEQ ID NO: 87987
  derived and/or modified sequence opt1 from hemagglutinin__InfluenzaB__AGX16665

SEQ ID NO: 88080 - RNA, 1758 nt, Artificial Sequence; identical to SEQ ID NO: 87987
  derived and/or modified sequence opt1 from hemagglutinin__InfluenzaB__AGX16676

SEQ ID NO: 88081 - RNA, 1758 nt, Artificial Sequence; identical to SEQ ID NO: 87987
  derived and/or modified sequence opt1 from hemagglutinin__InfluenzaB__AGX16687

SEQ ID NO: 88082 - RNA, 1758 nt, Artificial Sequence; identical to SEQ ID NO: 87987
  derived and/or modified sequence opt1 from hemagglutinin__InfluenzaB__AGX16698

SEQ ID NO: 88083 - RNA, 1758 nt, Artificial Sequence
  derived and/or modified sequence opt1 from hemagglutinin__InfluenzaB__AGX16709
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccgagaacaucccguccgccaaggugagcauccugcacgagguccggcccgugacguccggcugcuuccccaucaugcacgaccgcaccaagauccggcagcugcccaaccuccugcgcggcuacgagcacauccggcugagcacccacaacgugaucaacgccgagaaggcgcccgggggccccuacaagaucgggaccuccggcagcugccccaacgucacgaacgggaacggcuucuucgccaccauggccugggccgugcccaagaacgacaacaacaagaccgcgaccaacucccucacgaucgaggugccguacaucugcaccgagggcgaggaccagaucaccgucuggggguuccacagcgacaacgagacccagauggccaagcuguacggcgacuccaagccccagaaguucacgagcuccgccaacggggugaccacccacuacgugagccagaucggcggcuuccccaaccagaccgaggacgggggccugccccaguccgggcgcaucgucguggacuacauggugcagaaguccggcaagacggggaccaucaccuaccagcggggcauccuccugccgcagaaggucuggugcgccuccggccgcagcaaggugaucaaggggagccugccccucaucggcgaggccgacugccugcacgagaaguacgggggccugaacaaguccaagcccuacuacaccggggagcacgcgaaggccaucggcaacugccccaucugggugaagacgccgcucaagcuggccaacggcaccaaguaccggccgcccgccaagcugcucaaggagcgcggguucuucggcgccaucgcgggguuccuggagggcgggugggagggcaugaucgccggcuggcacggguacaccagccacggcgcccacggggucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgagggcaucaucaacagcgaggacgagcaccuccuggcgcuggagcggaagcucaagaagaugcuggggcccuccgccgucgagaucggcaacgggugcuucgagaccaagcacaagugcaaccagaccugccuggaccgcaucgccgccggcaccuucgacgcgggggaguucagccucccgacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88084 - RNA, 1758 nt, Artificial Sequence; identical to SEQ ID NO: 87987
  derived and/or modified sequence opt1 from hemagglutinin__InfluenzaB__AGX16720

SEQ ID NO: 88085 - RNA, 1758 nt, Artificial Sequence; identical to SEQ ID NO: 87987
  derived and/or modified sequence opt1 from hemagglutinin__InfluenzaB__AGX16731

SEQ ID NO: 88086 - RNA, 1758 nt, Artificial Sequence
  derived and/or modified sequence opt1 from hemagglutinin__InfluenzaB__AGX16742
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcaucauccacgagguccggcccgugacguccggcugcuuccccaucaugcacgaccgcaccaagauccggcagcugcccaaccugcuccgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacagcgacaacgagacccagauggccaagcucuacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccugcucccgcagaaggucuggugcgccuccgggcgcagcaaggugaucaagggcagccugccccugaucggggaggccgacugccuccacgagaaguacggcgggcugaacaaguccaagcccuacuacaccggcgagcacgcgaaggccaucggcaacugccccaucugggugaagacgccgcugaagcucgccaacgggaccaaguaccggccgcccgccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcggcucagcggcgccauggacgagcugcacaacgagauccuggagcucgacgagaagguggacgaccugcgcgccgacaccaucuccagccagaucgagcuggccgugcuccuguccaacgaggggaucaucaacagcgaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgggacaacguguccugcagcaucugccucuga

SEQ ID NO: 88087 - RNA, 1758 nt, Artificial Sequence; identical to SEQ ID NO: 87987
  derived and/or modified sequence opt1 from hemagglutinin__InfluenzaB__AGX16753

SEQ ID NO: 88088 - RNA, 1758 nt, Artificial Sequence; identical to SEQ ID NO: 87987
  derived and/or modified sequence opt1 from hemagglutinin__InfluenzaB__AGX16764

SEQ ID NO: 88089 - RNA, 1758 nt, Artificial Sequence; identical to SEQ ID NO: 87987
  derived and/or modified sequence opt1 from hemagglutinin__InfluenzaB__AGX16775

SEQ ID NO: 88090 - RNA, 1758 nt, Artificial Sequence
  derived and/or modified sequence opt1 from hemagglutinin__InfluenzaB__AGX16797
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaugccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88091 - RNA, 1758 nt, Artificial Sequence; identical to SEQ ID NO: 87987
  derived and/or modified sequence opt1 from hemagglutinin__InfluenzaB__AGX16808

SEQ ID NO: 88092 - RNA, 1758 nt, Artificial Sequence
  derived and/or modified sequence opt1 from hemagglutinin__InfluenzaB__AGX16819
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccgcaucgucguggacuacauggugcagaaguccgggaagacgggcaccaucaccuaccagcggggcauccuccugccgcagaaggucuggugcgccagcgggcgcagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucaucguguacauggucucccgggacaacgugagcugcagcaucugccuguga

SEQ ID NO: 88093 - RNA, 1758 nt, Artificial Sequence; identical to SEQ ID NO: 87987
  derived and/or modified sequence opt1 from hemagglutinin__InfluenzaB__AGX16830

SEQ ID NO: 88094 - RNA, 1758 nt, Artificial Sequence
  derived and/or modified sequence opt1 from hemagglutinin__InfluenzaB__AGX16841
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcaugaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacggcgacgggcucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88095 - RNA, 1758 nt, Artificial Sequence
  derived and/or modified sequence opt1 from hemagglutinin__InfluenzaB__AGX16852
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggaucagcggcgccauggacgagcugcacaacgagauccuggagcucgacgagaagguggacgaccugcgcgccgacaccaucuccagccagaucgagcuggccgugcuccuguccaacgaggggaucaucaacagcgaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgggacaacguguccugcagcaucugccucuga

SEQ ID NO: 88096 - RNA, 1758 nt, Artificial Sequence; identical to SEQ ID NO: 87987
  derived and/or modified sequence opt1 from hemagglutinin__InfluenzaB__AGX16863

SEQ ID NO: 88097 - RNA, 1758 nt, Artificial Sequence; identical to SEQ ID NO: 87987
  derived and/or modified sequence opt1 from hemagglutinin__InfluenzaB__AGX16874

SEQ ID NO: 88098 - RNA, 1758 nt, Artificial Sequence
  derived and/or modified sequence opt1 from hemagglutinin__InfluenzaB__AGX16885
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88099 - RNA, 1758 nt, Artificial Sequence; identical to SEQ ID NO: 88098
  derived and/or modified sequence opt1 from hemagglutinin__InfluenzaB__AGX16896

SEQ ID NO: 88100 - RNA, 1758 nt, Artificial Sequence; identical to SEQ ID NO: 87987
  derived and/or modified sequence opt1 from hemagglutinin__InfluenzaB__AGX16907

SEQ ID NO: 88101 - RNA, 1758 nt, Artificial Sequence; identical to SEQ ID NO: 88072
  derived and/or modified sequence opt1 from hemagglutinin__InfluenzaB__AGX16918

SEQ ID NO: 88102 - RNA, 1758 nt, Artificial Sequence; identical to SEQ ID NO: 87987
  derived and/or modified sequence opt1 from hemagglutinin__InfluenzaB__AGX16940

SEQ ID NO: 88103 - RNA, 1758 nt, Artificial Sequence; identical to SEQ ID NO: 88098
  derived and/or modified sequence opt1 from hemagglutinin__InfluenzaB__AGX16951

SEQ ID NO: 88104 - RNA, 1758 nt, Artificial Sequence
  derived and/or modified sequence opt1 from hemagglutinin__InfluenzaB__AGX16962
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaaggaggacggcgggcugccccaguccggccgcaucgucguggacuacauggugcagaaguccgggaacaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88105 - RNA, 1758 nt, Artificial Sequence; identical to SEQ ID NO: 87987
  derived and/or modified sequence opt1 from hemagglutinin__InfluenzaB__AGX16973

SEQ ID NO: 88106 - RNA, 1758 nt, Artificial Sequence
  derived and/or modified sequence opt1 from hemagglutinin__InfluenzaB__AGX16995
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgguggaggucccguacaucugcaccgagggggaggaccagaucaccguguggggcuuccacagcgacaacgagauccagauggccaagcuguacggggacuccaagccccagaaguucaccagcuccgccaacggcgugacgacccacuacgucagccagaucggcggguuccccaaccagaccgaggacggcgggcugccccaguccggccgcaucgugguggacuacaugguccagaaguccgggaagaccggcacgaucaccuaccagcggggcauccuccugccgcagaagguguggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggucaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgccgacacgaucuccagccagaucgagcucgccguccugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucgucguguacauggugagccgggacaacgucuccugcagcaucugccuguga

SEQ ID NO: 88107 - RNA, 1758 nt, Artificial Sequence
  derived and/or modified sequence opt1 from hemagglutinin__InfluenzaB__AGX17006
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88108 - RNA, 1758 nt, Artificial Sequence; identical to SEQ ID NO: 87987
  derived and/or modified sequence opt1 from hemagglutinin__InfluenzaB__AGX17017

SEQ ID NO: 88109 - RNA, 1758 nt, Artificial Sequence; identical to SEQ ID NO: 87987
  derived and/or modified sequence opt1 from hemagglutinin__InfluenzaB__AGX17028

SEQ ID NO: 88110 - RNA, 1758 nt, Artificial Sequence
  derived and/or modified sequence opt1 from hemagglutinin__InfluenzaB__AGX17039
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaacacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccaucaugcuguacuacuccaccgccgccagcucccuggcggugacgcugaugaucgccaucuucguggucuacauggugagccgggacaacguguccugcagcaucugccucuga

SEQ ID NO: 88111 - RNA, 1758 nt, Artificial Sequence; identical to SEQ ID NO: 87987
  derived and/or modified sequence opt1 from hemagglutinin__InfluenzaB__AGX17050

SEQ ID NO: 88112 - RNA, 1758 nt, Artificial Sequence
  derived and/or modified sequence opt1 from hemagglutinin__InfluenzaB__AGX17061
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggagcugccccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucaacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88113 - RNA, 1758 nt, Artificial Sequence
  derived and/or modified sequence opt1 from hemagglutinin__InfluenzaB__AGX17072
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaacacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88114 - RNA, 1758 nt, Artificial Sequence; identical to SEQ ID NO: 88098
  derived and/or modified sequence opt1 from hemagglutinin__InfluenzaB__AGX17083

SEQ ID NO: 88115 - RNA, 1758 nt, Artificial Sequence
  derived and/or modified sequence opt1 from hemagglutinin__InfluenzaB__AGX17094
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccgcaucgucguggacuacauggugcagaaguccgggaagacgggcaccaucaccuaccagcggggcauccuccugccgcagaaggucuggugcgccagcgggcgcagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcagcaucugccuguga

SEQ ID NO: 88116 - RNA, 1758 nt, Artificial Sequence
  derived and/or modified sequence opt1 from hemagglutinin__InfluenzaB__AGX17105
augaaggccaucaucgugcugcucauggucgugaccagcaacgccgaccgcaucugcaccggcaucacguccagcaacagcccccacguggucaagaccgcgacccagggggagaucaacgugaccggcgugaucccgcugacgaccacccccaccaagagccacuucgccaaccugaaggggacgaagacccggggcaagcucugccccaagugccugaacugcaccgaccuggacgucgcccucgggcgccccaagugcaccggcaacaucccguccgccaaggugagcauccugcacgaggugcggcccgucacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgugacgaacggcaacggcuucuucgccaccauggccugggccguccccaagaacgacaacaacaagaccgcgaccaacucccucacgaucgaggugccgcacaucugcaccgagggggaggaccagaucaccguguggggcuuccacagcgacaacgagauccagauggccaagcuguacggggacuccaagccccagaaguucaccagcuccgccaacggcgucacgacccacuacaucagccagaucggcggguuccccaaccagaccgaggacggcgggcugccccaguccggccgcaucgugguggacuacaugguccagaaguccgggaagaccggcacgaucaccuaccagcggggcauccuccugccgcagaagguguggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggucaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcguggccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccguccugcuguccaacgaggggaucaucaacagcgaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88117 - RNA, 1758 nt, Artificial Sequence; identical to SEQ ID NO: 88098
  derived and/or modified sequence opt1 from hemagglutinin__InfluenzaB__AGX17116

SEQ ID NO: 88118 - RNA, 1758 nt, Artificial Sequence
  derived and/or modified sequence opt1 from hemagglutinin__InfluenzaB__AGX17127
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaacaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88119 - RNA, 1758 nt, Artificial Sequence; identical to SEQ ID NO: 88107
  derived and/or modified sequence opt1 from hemagglutinin__InfluenzaB__AGX17138

SEQ ID NO: 88120 - RNA, 1758 nt, Artificial Sequence; identical to SEQ ID NO: 88107
  derived and/or modified sequence opt1 from hemagglutinin__InfluenzaB__AGX17149

SEQ ID NO: 88121 - RNA, 1758 nt, Artificial Sequence
  derived and/or modified sequence opt1 from hemagglutinin__InfluenzaB__AGX17160
augaaggccaucaucgugcugcucauggucgugaccagcaacgccgaccgcaucugcaccggcaucacguccagcaacagcccccacguggucaagaccgcgacccagggggaggugaacgugaccggcaugaucccgcugacgaccacccccaccaagagccacuucgccaaccugaaggggacgaagacccggggcaagcucugccccaagugccugaacugcaccgaccuggacgucgcccucgggcgccccaagugcaccggcaacaucccguccgccaaggugagcauccugcacgaggugcggcccgucacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgugacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88122 - RNA, 1758 nt, Artificial Sequence
  derived and/or modified sequence opt1 from hemagglutinin__InfluenzaB__AGX17171
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacaaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaacaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgggacaacguguccugcagcaucugccuguga

SEQ ID NO: 88123 - RNA, 1758 nt, Artificial Sequence; identical to SEQ ID NO: 87987
  derived and/or modified sequence opt1 from hemagglutinin__InfluenzaB__AGX17182

SEQ ID NO: 88124 - RNA, 1758 nt, Artificial Sequence; identical to SEQ ID NO: 87987
  derived and/or modified sequence opt1 from hemagglutinin__InfluenzaB__AGX17193

SEQ ID NO: 88125 - RNA, 1758 nt, Artificial Sequence; identical to SEQ ID NO: 87987
  derived and/or modified sequence opt1 from hemagglutinin__InfluenzaB__AGX17204

SEQ ID NO: 88126 - RNA, 1758 nt, Artificial Sequence
  derived and/or modified sequence opt1 from hemagglutinin__InfluenzaB__AGX17215
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccaucgagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 88127 - RNA, 1758 nt, Artificial Sequence; identical to SEQ ID NO: 87987
  derived and/or modified sequence opt1 from hemagglutinin__InfluenzaB__AGX17226

SEQ ID NO: 88128 - RNA, 1758 nt, Artificial Sequence
  derived and/or modified sequence opt1 from hemagglutinin__InfluenzaB__AGX17237
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagauccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggucacccucaugaucgccaucuucgugguguacauggucagccgggacaacguguccugcagcaucugccuguga

SEQ ID NO: 88129 - RNA, 1758 nt, Artificial Sequence
  derived and/or modified sequence opt1 from hemagglutinin__InfluenzaB__AGX17248
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcaccuccgggcgcagcaaggugaucaagggcagccugccccucaucggggaggccgacugccugcacgagaaguacggcgggcugaacaaguccaagcccuacuacacgggcgagcacgccaaggcgaucggcaacugccccaucugggugaagaccccgcucaagcuggccaacgggaccaaguaccggccgcccgccaagcugcucaaggagcgcggcuucuucggggccaucgccggcuuccuggagggcgggugggagggcaugaucgcgggguggcacggcuacaccagccacggggcccacggcgucgccguggccgccgaccugaaguccacgcaggaggcgaucaacaagaucaccaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcccuggagcggaagcucaagaagaugcugggccccuccgcggucgagaucgggaacggcugcuucgagaccaagcacaagugcaaccagaccugccuggaccgcaucgccgccgggacguucgacgccggcgaguucagccuccccaccuucgacucccugaacaucaccgcggccagccugaacgacgacggccucgacaaccacaccauccugcuguacuacuccacggccgccagcucccuggccgugacccucaugaucgcgaucuucguggucuacauggugagccgggacaacguguccugcagcaucugccuguga

SEQ ID NO: 88130 - RNA, 1758 nt, Artificial Sequence; identical to SEQ ID NO: 88071
  derived and/or modified sequence opt1 from hemagglutinin__InfluenzaB__AGX17270

SEQ ID NO: 88131 - RNA, 1758 nt, Artificial Sequence; identical to SEQ ID NO: 87987
  derived and/or modified sequence opt1 from hemagglutinin__InfluenzaB__AGX17281

SEQ ID NO: 88132 - RNA, 1758 nt, Artificial Sequence; identical to SEQ ID NO: 87987
  derived and/or modified sequence opt1 from hemagglutinin__InfluenzaB__AGX17292

SEQ ID NO: 88133 - RNA, 1758 nt, Artificial Sequence; identical to SEQ ID NO: 87987
  derived and/or modified sequence opt1 from hemagglutinin__InfluenzaB__AGX17303

SEQ ID NO: 88134 - RNA, 1758 nt, Artificial Sequence; identical to SEQ ID NO: 88113
  derived and/or modified sequence opt1 from hemagglutinin__InfluenzaB__AGX17314

SEQ ID NO: 88135 - RNA, 1758 nt, Artificial Sequence; identical to SEQ ID NO: 87987
  derived and/or modified sequence opt1 from hemagglutinin__InfluenzaB__AGX17325

SEQ ID NO: 88136 - RNA, 1758 nt, Artificial Sequence; identical to SEQ ID NO: 88098
  derived and/or modified sequence opt1 from hemagglutinin__InfluenzaB__AGX17336

SEQ ID NO: 88137 - RNA, 1758 nt, Artificial Sequence; identical to SEQ ID NO: 87987
  derived and/or modified sequence opt1 from hemagglutinin__InfluenzaB__AGX17347

SEQ ID NO: 88138 - RNA, 1758 nt, Artificial Sequence; identical to SEQ ID NO: 87987
  derived and/or modified sequence opt1 from hemagglutinin__InfluenzaB__AGX17358

SEQ ID NO: 88139 - RNA, 1758 nt, Artificial Sequence
  derived and/or modified sequence opt1 from hemagglutinin__InfluenzaB__AGX17369
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucgccgacuacauggugcagaaguccgggaagacgggcaccaucaccuaccagcggggcauccuccugccgcagaagguguggugcgccuccgggcgcagcaaggucaucaagggcagccugccccucaucggggaggcggacugccugcacgagaaguacggcgggcugaacaaguccaagcccuacuacaccggcgagcacgccaaggccaucggcaacugccccaucugggugaagacgccgcucaagcuggccaacgggaccaaguaccggccgcccgccaagcugcucaaggagcgcggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgcggugcugcuguccaacgaggggaucaucaacagcgaggacgagcaccuccuggcccuggagcggaagcucaagaagaugcugggccccuccgccguggagaucgggaacggcugcuucgagaccaagcacaagugcaaccagaccugccuggaccgcaucgccgcggggaccuucgacgccggcgaguucagccuccccacguucgacucccugaacaucaccgccgccagccugaacgacgacggccucgacaaccacaccauccugcuguacuacuccaccgccgcgagcucccuggccgucacgcucaugaucgccaucuucgugguguacauggucagccgggacaacguguccugcagcaucugccuguga

SEQ ID NO: 88140 - RNA, 1758 nt, Artificial Sequence; identical to SEQ ID NO: 88113
  derived and/or modified sequence opt1 from hemagglutinin__InfluenzaB__AGX17380

SEQ ID NO: 88141 - RNA, 1758 nt, Artificial Sequence; identical to SEQ ID NO: 87987
  derived and/or modified sequence opt1 from hemagglutinin__InfluenzaB__AGX17391

SEQ ID NO: 88142 - RNA, 1758 nt, Artificial Sequence
  derived and/or modified sequence opt1 from hemagglutinin__InfluenzaB__AGX17400
augaaggccaucaucgugcugcucauggucgugaccagcaacgccgaccgcaucugcaccggcaucacguccagcaacagcccccacauggugaagaccgcgacccagggggaggucaacgugaccggcgugaucccgcugacgaccacccccaccaagagccacuucgccaaccugaaggggacgaagacccggggcaagcucugccccaagugccugaacugcaccgaccuggacgucgcccucgggcgccccaagugcaccggcaacaucccguccgccaaggugagcauccugcacgaggugcggcccgucacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgugacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88143 - RNA, 1758 nt, Artificial Sequence; identical to SEQ ID NO: 87987
  derived and/or modified sequence opt1 from hemagglutinin__InfluenzaB__AGX17411

SEQ ID NO: 88144 - RNA, 1758 nt, Artificial Sequence; identical to SEQ ID NO: 87987
  derived and/or modified sequence opt1 from hemagglutinin__InfluenzaB__AGX17422

SEQ ID NO: 88145 - RNA, 1758 nt, Artificial Sequence; identical to SEQ ID NO: 88070
  derived and/or modified sequence opt1 from hemagglutinin__InfluenzaB__AGX17433

SEQ ID NO: 88146 - RNA, 1758 nt, Artificial Sequence; identical to SEQ ID NO: 87987
  derived and/or modified sequence opt1 from hemagglutinin__InfluenzaB__AGX17444

SEQ ID NO: 88147 - RNA, 1758 nt, Artificial Sequence; identical to SEQ ID NO: 88070
  derived and/or modified sequence opt1 from hemagglutinin__InfluenzaB__AGX17455

SEQ ID NO: 88148 - RNA, 1758 nt, Artificial Sequence; identical to SEQ ID NO: 88113
  derived and/or modified sequence opt1 from hemagglutinin__InfluenzaB__AGX17466

SEQ ID NO: 88149 - RNA, 1758 nt, Artificial Sequence; identical to SEQ ID NO: 87987
  derived and/or modified sequence opt1 from hemagglutinin__InfluenzaB__AGX17477

SEQ ID NO: 88150 - RNA, 1758 nt, Artificial Sequence; identical to SEQ ID NO: 88072
  derived and/or modified sequence opt1 from hemagglutinin__InfluenzaB__AGX17488

SEQ ID NO: 88151 - RNA, 1758 nt, Artificial Sequence; identical to SEQ ID NO: 87987
  derived and/or modified sequence opt1 from hemagglutinin__InfluenzaB__AGX17499

SEQ ID NO: 88152 - RNA, 1758 nt, Artificial Sequence; identical to SEQ ID NO: 88113
  derived and/or modified sequence opt1 from hemagglutinin__InfluenzaB__AGX17510

SEQ ID NO: 88153 - RNA, 1758 nt, Artificial Sequence; identical to SEQ ID NO: 88113
  derived and/or modified sequence opt1 from hemagglutinin__InfluenzaB__AGX17521

SEQ ID NO: 88154 - RNA, 1758 nt, Artificial Sequence; identical to SEQ ID NO: 88115
  derived and/or modified sequence opt1 from hemagglutinin__InfluenzaB__AGX17532

SEQ ID NO: 88155 - RNA, 1758 nt, Artificial Sequence
  derived and/or modified sequence opt1 from hemagglutinin__InfluenzaB__AGX17543
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccucccugaaggggacgaagacccggggcaagcucugccccaagugccugaacugcaccgaccuggacguggcccucgggcgccccaagugcaccggcaacaucccgagcgccaagguguccauccugcacgagguccggcccgugacgagcggcugcuuccccaucaugcacgaccgcaccaagauccggcagcugcccaaccuccugcgcggguacgagcacauccggcuguccacccacaacgugaucaacgccgagaaggcgccgggcgggcccuacaagaucggcaccagcggguccugccccaacgucacgaacggcaacggcuucuucgccaccauggccugggccgugcccaagaacgacaacaacaagaccgcgaccaacagccucacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccccagagcggccgcaucgucguggacuacauggugcagaaguccgggaagacgggcaccaucaccuaccagcggggcauccuccugccgcagaaggucuggugcgccagcgggcgcagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccaugaacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcagcaucugccuguga

SEQ ID NO: 88156 - RNA, 1758 nt, Artificial Sequence
  derived and/or modified sequence opt1 from hemagglutinin__InfluenzaB__AGX17554
augaaggccaucaucgugcugcuccuggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccucaaggggacgaagacccggggcaagcugugccccaagugccugaacugcaccgaccucgacguggcccuggggcgccccaagugcaccggcaacaucccguccgccaaggugagcauccugcacgagguccggcccgugacguccggcugcuuccccaucaugcacgaccgcaccaagauccggcagcuccccaaccugcugcgcggguacgagcacauccggcucagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcucccccaguccggccgcaucgucguggacuacauggugcagaaguccgggaagacgggcaccaucaccuaccagcggggcauccugcugccgcagaaggucuggugcgccuccgggcgcagcaaggugaucaagggcagccucccccugaucggggaggccgacugccugcacgagaaguacggcgggcucaacaaguccaagcccuacuacaccggcgagcacgcgaaggccaucggcaacugccccaucugggugaagacgccgcugaagcuggccaacgggaccaaguaccggccgcccgccaagcuccugaaggagcgcggcuucuucggggccaucgcgggcuuccuggagggcgggugggagggcaugaucgccggguggcacggcuacaccagccacggggcccacggcgucgccguggccgcggaccucaaguccacccaggaggccaucaacaagaucacgaagaaccugaacagccuguccgagcucgaggucaagaaccugcagcggcugagcggcgccauggacgagcuccacaacgagauccuggagcuggacgagaagguggacgaccuccgcgccgacaccaucuccagccagaucgagcuggccgugcugcucuccaacgaggggaucaucaacagcgaggacgagcaccuccuggcgcuggagcggaagcugaagaagaugcugggccccuccgccgucgagaucgggaacggcugcuucgagaccaagcacaagugcaaccagaccugccucgaccgcaucgccgccgggaccuucgacgcgggcgaguucagccugcccacguucgacucccugaacaucaccgccgccagccucaacgacgacggccuggacaaccacaccauccugcuguacuacuccaccgccgccagcucccucgcggugacgcugaugaucgccaucuucguggucuacauggugagccgggacaacguguccugcagcaucugccuguga

SEQ ID NO: 88157 - RNA, 1755 nt, Artificial Sequence; identical to SEQ ID NO: 88031
  derived and/or modified sequence opt1 from hemagglutinin__InfluenzaB__AGX17565

SEQ ID NO: 88158 - RNA, 1758 nt, Artificial Sequence
  derived and/or modified sequence opt1 from hemagglutinin__InfluenzaB__AGX17576
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugauggccaucuucgugguguacauggucagccgggacaacguguccugcagcaucugccuguga

SEQ ID NO: 88159 - RNA, 1758 nt, Artificial Sequence; identical to SEQ ID NO: 87522
  derived and/or modified sequence opt1 from hemagglutinin__InfluenzaB__AGX17598

SEQ ID NO: 88160 - RNA, 1758 nt, Artificial Sequence
  derived and/or modified sequence opt1 from hemagglutinin__InfluenzaB__AGX17609
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88161 - RNA, 1758 nt, Artificial Sequence; identical to SEQ ID NO: 87989
  derived and/or modified sequence opt1 from hemagglutinin__InfluenzaB__AGX17620

SEQ ID NO: 88162 - RNA, 1758 nt, Artificial Sequence; identical to SEQ ID NO: 87522
  derived and/or modified sequence opt1 from hemagglutinin__InfluenzaB__AGX17631

SEQ ID NO: 88163 - RNA, 1758 nt, Artificial Sequence; identical to SEQ ID NO: 87646
  derived and/or modified sequence opt1 from hemagglutinin__InfluenzaB__AGX17642

SEQ ID NO: 88164 - RNA, 1758 nt, Artificial Sequence; identical to SEQ ID NO: 87989
  derived and/or modified sequence opt1 from hemagglutinin__InfluenzaB__AGX17653

SEQ ID NO: 88165 - RNA, 1758 nt, Artificial Sequence; identical to SEQ ID NO: 87522
  derived and/or modified sequence opt1 from hemagglutinin__InfluenzaB__AGX17664

SEQ ID NO: 88166 - RNA, 1758 nt, Artificial Sequence; identical to SEQ ID NO: 87646
  derived and/or modified sequence opt1 from hemagglutinin__InfluenzaB__AGX17675

SEQ ID NO: 88167 - RNA, 1758 nt, Artificial Sequence; identical to SEQ ID NO: 87989
  derived and/or modified sequence opt1 from hemagglutinin__InfluenzaB__AGX17686

SEQ ID NO: 88168 - RNA, 1758 nt, Artificial Sequence
  derived and/or modified sequence opt1 from hemagglutinin__InfluenzaB__AGX17697
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcgagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgccaucaacgcggagaacgccccgggcgggcccuacaagaucggcaccuccgggagcugccccaacgugacgaacggcaacggcuucuucgccaccauggccugggcgguccccaagaacgacaacaacaagaccgccaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggcggacugccugcacgagaaguacggcgggcugaacaaguccaagcccuacuacaccggcgagcacgccaaggccaucggcaacugccccaucugggugaagacgccgcucaagcuggccaacgggaccaaguaccgcccgcccgccaagcugcucaaggagcggggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccguggagaucgggaacggcugcuucgagaccaagcacaagugcaaccagaccugccuggaccggaucgccgcggggaccuucgacgccggcgaguucagccuccccacguucgacucccugaacaucaccgccgccagccugaacgacgacggccucgacaaccacaccauccugcuguacuacuccaccgccgcgagcucccuggccgucacgcucaugaucgccaucuucgugguguacauggucagccgcgacaacguguccugcagcaucugccuguga

SEQ ID NO: 88169 - RNA, 1758 nt, Artificial Sequence; identical to SEQ ID NO: 87646
  derived and/or modified sequence opt1 from hemagglutinin__InfluenzaB__AGX17708

SEQ ID NO: 88170 - RNA, 1758 nt, Artificial Sequence; identical to SEQ ID NO: 87989
  derived and/or modified sequence opt1 from hemagglutinin__InfluenzaB__AGX17719

SEQ ID NO: 88171 - RNA, 1758 nt, Artificial Sequence; identical to SEQ ID NO: 87646
  derived and/or modified sequence opt1 from hemagglutinin__InfluenzaB__AGX17730

SEQ ID NO: 88172 - RNA, 1758 nt, Artificial Sequence; identical to SEQ ID NO: 87522
  derived and/or modified sequence opt1 from hemagglutinin__InfluenzaB__AGX17741

SEQ ID NO: 88173 - RNA, 1758 nt, Artificial Sequence; identical to SEQ ID NO: 87989
  derived and/or modified sequence opt1 from hemagglutinin__InfluenzaB__AGX17752

SEQ ID NO: 88174 - RNA, 1758 nt, Artificial Sequence; identical to SEQ ID NO: 87989
  derived and/or modified sequence opt1 from hemagglutinin__InfluenzaB__AGX17774

SEQ ID NO: 88175 - RNA, 1758 nt, Artificial Sequence
  derived and/or modified sequence opt1 from hemagglutinin__InfluenzaB__AGX17785
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacgugcggcugagcacccacaacgucaucaacgccgagaaggcgccgggcgggcccuacaagaucggcaccuccgggagcugccccaacgugacgaacggcaacggcuucuucgccaccauggccugggccgugcccaagaacgacaacaacaagaccgcgaccaacucccucacgaucgaggucccguacaucugcaccgagggggaggaccagaucaccaucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88176 - RNA, 1758 nt, Artificial Sequence; identical to SEQ ID NO: 87989
  derived and/or modified sequence opt1 from hemagglutinin__InfluenzaB__AGX17796

SEQ ID NO: 88177 - RNA, 1758 nt, Artificial Sequence; identical to SEQ ID NO: 87573
  derived and/or modified sequence opt1 from hemagglutinin__InfluenzaB__AGX17807

SEQ ID NO: 88178 - RNA, 1758 nt, Artificial Sequence; identical to SEQ ID NO: 88160
  derived and/or modified sequence opt1 from hemagglutinin__InfluenzaB__AGX17818

SEQ ID NO: 88179 - RNA, 1758 nt, Artificial Sequence
  derived and/or modified sequence opt1 from hemagglutinin__InfluenzaB__AGX17829
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccgucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgcgacaacgucuccugcagcaucugccuguga

SEQ ID NO: 88180 - RNA, 1758 nt, Artificial Sequence; identical to SEQ ID NO: 87646
  derived and/or modified sequence opt1 from hemagglutinin__InfluenzaB__AGX17840

SEQ ID NO: 88181 - RNA, 1758 nt, Artificial Sequence; identical to SEQ ID NO: 87989
  derived and/or modified sequence opt1 from hemagglutinin__InfluenzaB__AGX17851

SEQ ID NO: 88182 - RNA, 1758 nt, Artificial Sequence
  derived and/or modified sequence opt1 from hemagglutinin__InfluenzaB__AGX17862
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcacccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacgcaggaggccaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggucacccucaugaucgccaucuucgugguguacauggucucccgggacaacgugagcugcuccaucugccuguga

SEQ ID NO: 88183 - RNA, 1758 nt, Artificial Sequence
  derived and/or modified sequence opt1 from hemagglutinin__InfluenzaB__AGX17873
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccuggacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88184 - RNA, 1758 nt, Artificial Sequence; identical to SEQ ID NO: 87646
  derived and/or modified sequence opt1 from hemagglutinin__InfluenzaB__AGX17884

SEQ ID NO: 88185 - RNA, 1758 nt, Artificial Sequence
  derived and/or modified sequence opt1 from hemagglutinin__InfluenzaB__AGX17895
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88186 - RNA, 1758 nt, Artificial Sequence; identical to SEQ ID NO: 87646
  derived and/or modified sequence opt1 from hemagglutinin__InfluenzaB__AGX17906

SEQ ID NO: 88187 - RNA, 1758 nt, Artificial Sequence; identical to SEQ ID NO: 87646
  derived and/or modified sequence opt1 from hemagglutinin__InfluenzaB__AGX17917

SEQ ID NO: 88188 - RNA, 1758 nt, Artificial Sequence
  derived and/or modified sequence opt1 from hemagglutinin__InfluenzaB__AGX17928
augaagaccaucaucgugcugcucauggucgugaccagcaacgccgaccgcaucugcacgggcaucaccuccagcaacagcccccacguggucaagaccgccacccagggggaggugaacgugacgggcgucaucccgcugaccaccacccccaccaagagccacuucgcgaaccugaaggggacgaagacccggggcaagcucugccccaagugccugaacugcaccgaccuggacguggcccucgggcgccccaagugcacgggcaacaucccguccgccgaggugagcauccugcacgagguccggcccgugaccuccggcugcuuccccaucaugcacgaccgcaccaagauccggcagcugcccaaccuccugcgcggguacgagcacauccggcugagcacccacaacgugaucaacgccgagaaggccccgggcgggcccuacaagaucggcacguccgggagcugccccaacgucaccaacggcaacggcuucuucgcgaccauggccugggccgugcccaagaacgacaacaacaagaccgccacgaacucccucaccaucgaggugccguacaucugcaccgagggggaggaccagaucaccaucuggggcuuccacagcgacaacgagacgcagauggcgaagcuguacggggacuccaagccccagaaguucaccagcuccgccaacggcgucaccacccacuacgugagccagaucggcggguuccccaaccagacggaggacggcgggcugccccaguccggccgcaucguggucgacuacauggugcagaaguccgggaagaccggcaccaucaccuaccagcggggcauccuccugccgcagaagguguggugcgccuccgggcgcagcaaggucaucaagggcacgcugccccucaucggggaggccgacugccugcacgagaaguacggcgggcugaacaagagcaagcccuacuacaccggcgagcacgccaaggcgaucggcaacugccccaucugggugaagaccccgcucaagcuggccaacgggaccaaguaccggccgcccgccaagcugcucaaggagcgcggcuucuucggggccaucgccggcuuccuggagggcgggugggagggcaugaucgcgggguggcacggcuacacgucccacggggcccacggcguggccgucgccgccgaccucaagagcacccaggaggcgaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcccuggagcggaagcucaagaagaugcugggccccagcgcgguggagaucgggaacggcugcuucgagaccaagcacaagugcaaccagacgugccuggaccgcaucgccgccgggaccuucgacgccggcgaguucucccuccccaccuucgacagccugaacaucaccgcggccucccugaacgacgacggccucgacaaccacacgauccugcuguacuacagcaccgccgccuccagccuggccgucacccucaugaucgcgaucuucgugguguacauggucucccgggacaacgugagcugcuccaucugccuguga

SEQ ID NO: 88189 - RNA, 1758 nt, Artificial Sequence; identical to SEQ ID NO: 87522
  derived and/or modified sequence opt1 from hemagglutinin__InfluenzaB__AGX17939

SEQ ID NO: 88190 - RNA, 1758 nt, Artificial Sequence; identical to SEQ ID NO: 87522
  derived and/or modified sequence opt1 from hemagglutinin__InfluenzaB__AGX17950

SEQ ID NO: 88191 - RNA, 1758 nt, Artificial Sequence; identical to SEQ ID NO: 87522
  derived and/or modified sequence opt1 from hemagglutinin__InfluenzaB__AGX17961

SEQ ID NO: 88192 - RNA, 1758 nt, Artificial Sequence; identical to SEQ ID NO: 87989
  derived and/or modified sequence opt1 from hemagglutinin__InfluenzaB__AGX17972

SEQ ID NO: 88193 - RNA, 1758 nt, Artificial Sequence; identical to SEQ ID NO: 87522
  derived and/or modified sequence opt1 from hemagglutinin__InfluenzaB__AGX17983

SEQ ID NO: 88194 - RNA, 1758 nt, Artificial Sequence; identical to SEQ ID NO: 87646
  derived and/or modified sequence opt1 from hemagglutinin__InfluenzaB__AGX17994

SEQ ID NO: 88195 - RNA, 1758 nt, Artificial Sequence
  derived and/or modified sequence opt1 from hemagglutinin__InfluenzaB__AGX18005
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggacaucaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 88196 - RNA, 1758 nt, Artificial Sequence
  derived and/or modified sequence opt1 from hemagglutinin__InfluenzaB__AGX18016
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaucgagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88197 - RNA, 1758 nt, Artificial Sequence; identical to SEQ ID NO: 88160
  derived and/or modified sequence opt1 from hemagglutinin__InfluenzaB__AGX18027

SEQ ID NO: 88198 - RNA, 1758 nt, Artificial Sequence; identical to SEQ ID NO: 87646
  derived and/or modified sequence opt1 from hemagglutinin__InfluenzaB__AGX18038

SEQ ID NO: 88199 - RNA, 1758 nt, Artificial Sequence; identical to SEQ ID NO: 87646
  derived and/or modified sequence opt1 from hemagglutinin__InfluenzaB__AGX18049

SEQ ID NO: 88200 - RNA, 1758 nt, Artificial Sequence; identical to SEQ ID NO: 87646
  derived and/or modified sequence opt1 from hemagglutinin__InfluenzaB__AGX18060

SEQ ID NO: 88201 - RNA, 1758 nt, Artificial Sequence; identical to SEQ ID NO: 87522
  derived and/or modified sequence opt1 from hemagglutinin__InfluenzaB__AGX18071

SEQ ID NO: 88202 - RNA, 1758 nt, Artificial Sequence; identical to SEQ ID NO: 88182
  derived and/or modified sequence opt1 from hemagglutinin__InfluenzaB__AGX18082

SEQ ID NO: 88203 - RNA, 1758 nt, Artificial Sequence; identical to SEQ ID NO: 88182
  derived and/or modified sequence opt1 from hemagglutinin__InfluenzaB__AGX18093

SEQ ID NO: 88204 - RNA, 1758 nt, Artificial Sequence; identical to SEQ ID NO: 87989
  derived and/or modified sequence opt1 from hemagglutinin__InfluenzaB__AGX18104

SEQ ID NO: 88205 - RNA, 1758 nt, Artificial Sequence; identical to SEQ ID NO: 87646
  derived and/or modified sequence opt1 from hemagglutinin__InfluenzaB__AGX18115

SEQ ID NO: 88206 - RNA, 1758 nt, Artificial Sequence; identical to SEQ ID NO: 87646
  derived and/or modified sequence opt1 from hemagglutinin__InfluenzaB__AGX18126

SEQ ID NO: 88207 - RNA, 1758 nt, Artificial Sequence; identical to SEQ ID NO: 87522
  derived and/or modified sequence opt1 from hemagglutinin__InfluenzaB__AGX18137

SEQ ID NO: 88208 - RNA, 1758 nt, Artificial Sequence; identical to SEQ ID NO: 88182
  derived and/or modified sequence opt1 from hemagglutinin__InfluenzaB__AGX18148

SEQ ID NO: 88209 - RNA, 1758 nt, Artificial Sequence; identical to SEQ ID NO: 87522
  derived and/or modified sequence opt1 from hemagglutinin__InfluenzaB__AGX18159

SEQ ID NO: 88210 - RNA, 1758 nt, Artificial Sequence; identical to SEQ ID NO: 87522
  derived and/or modified sequence opt1 from hemagglutinin__InfluenzaB__AGX18170

SEQ ID NO: 88211 - RNA, 1758 nt, Artificial Sequence; identical to SEQ ID NO: 88182
  derived and/or modified sequence opt1 from hemagglutinin__InfluenzaB__AGX18181

SEQ ID NO: 88212 - RNA, 1758 nt, Artificial Sequence
  derived and/or modified sequence opt1 from hemagglutinin__InfluenzaB__AGX18192
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccaccaacggcgucaccacccacuacgugagccagaucggcggguuccccaaccagacggaggacggcgggcugccccaguccggccgcaucguggucgacuacauggugcagaagccggggaagaccggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccggccgcccgccaagcugcucaaggagcgcggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucaccaagaaccucaacucccugagcgagcuggaggugaagaaccuccagcggcuguccagcgccauggacgagcugcacaacgagauccucgagcuggacgagaaggucgacgaccugcgcgccgacaccaucuccagccagaucgagcucgccgugcugcuguccaacgagggcaucaucaacagcgaggacgagcaccuccuggcccuggagcggaagcucaagaagaugcuggggcccuccgcgguggagaucggcaacgggugcuucgagaccaagcacaagugcaaccagaccugccuggaccgcaucgccgccggcacguucgacgccggggaguucagccuccccaccuucgacucccugaacaucaccgcggccagccugaacgacgacggccucgacaaccacaccauccugcuguacuacuccacggccgccagcucccuggccgucacccucaugaucgcgaucuucgugguguacauggucagccgggacaacguguccugcagcaucugccuguga

SEQ ID NO: 88213 - RNA, 1758 nt, Artificial Sequence; identical to SEQ ID NO: 88160
  derived and/or modified sequence opt1 from hemagglutinin__InfluenzaB__AGX18203

SEQ ID NO: 88214 - RNA, 1758 nt, Artificial Sequence
  derived and/or modified sequence opt1 from hemagglutinin__InfluenzaB__AGX18214
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaccggcacguccgggagcugccccaacgucaccaacggcaacggcuucuucgccaccauggccugggccgugcccaagaacgacaacaacaagaccgcgacgaacucccucaccaucgaggugccguacaucugcaccgagggggaggaccagaucaccaucuggggcuuccacagcgacaacgagacgcagauggccaagcuguacggggacuccaagccccagaaguucaccagcuccgccaacggcgucaccacccacuacgugagccagaucggcggguuccccaaccagacggaggacggcgggcugccccaguccggccgcaucguggucgacuacauggugcagaaguccgggaagaccggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacgcaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggacguucgacgcgggcgaguucagccuccccaccuucgacucccugaacaucaccgccgccagccugaacgacgacggccucgacaaccacaucauccugcuguacuacuccaccgccgccagcucccuggcggucacgcucaugaucgccaucuucgugguguacauggucagccgggacaacguguccugcagcaucugccuguga

SEQ ID NO: 88215 - RNA, 1758 nt, Artificial Sequence
  derived and/or modified sequence opt1 from hemagglutinin__InfluenzaB__AGX18225
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaaccggaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 88216 - RNA, 1758 nt, Artificial Sequence
  derived and/or modified sequence opt1 from hemagglutinin__InfluenzaB__AGX18236
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacaugaugcagaaguccgggaagacgggcaccaucaccuaccagcggggcauccuccugccgcagaagguguggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggucaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccguccugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgggacaacgucuccugcagcaucugccuguga

SEQ ID NO: 88217 - RNA, 1758 nt, Artificial Sequence; identical to SEQ ID NO: 87573
  derived and/or modified sequence opt1 from hemagglutinin__InfluenzaB__AGX18247

SEQ ID NO: 88218 - RNA, 1758 nt, Artificial Sequence
  derived and/or modified sequence opt1 from hemagglutinin__InfluenzaB__AGX18258
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcacccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacgcaggaggccaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggucacccucaugaucgccaucuucgugguguacauggucucccgggacaacgugagcugcuccaucugccuguga

SEQ ID NO: 88219 - RNA, 1758 nt, Artificial Sequence; identical to SEQ ID NO: 87522
  derived and/or modified sequence opt1 from hemagglutinin__InfluenzaB__AGX18280

SEQ ID NO: 88220 - RNA, 1758 nt, Artificial Sequence
  derived and/or modified sequence opt1 from hemagglutinin__InfluenzaB__AGX18291
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgucuccgggcgcagcaaggugaucaagggcagccugccccucaucggggaggccgacugccugcacgagaaguacggcgggcugaacaaguccaagcccuacuacaccggcgagcacgccaaggcgaucggcaacugccccaucugggugaagacgccgcucaagcuggccaacgggaccaaguaccggccgcccgccaagcugcucaaggagcgcggcuucuucggggccaucgccggcuuccuggagggcgggugggagggcaugaucgcgggguggcacggcuacaccagccacggggcccacggcgucgccguggccgccgaccugaaguccacccaggaggcgaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcccuggagcggaagcucaagaagaugcugggccccuccgcggucgagaucgggaacggcugcuucgagaccaagcacaagugcaaccagaccugccuggaccgcaucgccgccgggaccuucgacgccggcgaguucagccuccccacguucgacucccugaacaucaccgcggccagccugaacgacgacggccucgacaaccacaccauccugcuguacuacuccaccgccgccagcucccuggccgugacgcucaugaucgcgaucuucguggucuacauggugagccgggacaacguguccugcagcaucugccuguga

SEQ ID NO: 88221 - RNA, 1758 nt, Artificial Sequence
  derived and/or modified sequence opt1 from hemagglutinin__InfluenzaB__AGX18302
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacaagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcacccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacgcaggaggccaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggucacccucaugaucgccaucuucgugguguacauggucucccgggacaacgugagcugcuccaucugccuguga

SEQ ID NO: 88222 - RNA, 1758 nt, Artificial Sequence; identical to SEQ ID NO: 87522
  derived and/or modified sequence opt1 from hemagglutinin__InfluenzaB__AGX18313

SEQ ID NO: 88223 - RNA, 1758 nt, Artificial Sequence
  derived and/or modified sequence opt1 from hemagglutinin__InfluenzaB__AGX18324
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgaggcccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccguggagaucgggaacggcugcuucgagaccaagcacaagugcaaccagaccugccuggaccgcaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 88224 - RNA, 1758 nt, Artificial Sequence; identical to SEQ ID NO: 88182
  derived and/or modified sequence opt1 from hemagglutinin__InfluenzaB__AGX18335

SEQ ID NO: 88225 - RNA, 1758 nt, Artificial Sequence
  derived and/or modified sequence opt1 from hemagglutinin__InfluenzaB__AGX18346
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgaggacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88226 - RNA, 1758 nt, Artificial Sequence
  derived and/or modified sequence opt1 from hemagglutinin__InfluenzaB__AGX18357
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaagagccacuucgccaaccugaaggggaccaagacgcggggcaagcucugccccaagugccugaacugcaccgaccuggacguggcccucgggcgccccaagugcaccggcaacaucccguccgccgaggugagcauccugcacgagguccggcccgugaccuccggcugcuuccccaucaugcacgaccgcacgaagauccggcagcugcccaaccuccugcgcggguacgagcacauccggcugagcacccacaacgugaucaacgcggagaaggccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccaucuggggcuuccacagcgacaaggagacccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaagccggggaagaccggcacgaucaccuaccagcggggcauccuccugccccagaagguguggugcgccagcgggcgcuccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcggcuguccagcgccauggacgagcugcacaacgagauccucgagcuggacgagaaggucgacgaccugcgcgccgacacgaucuccagccagaucgagcucgcggugcugcuguccaacgagggcaucaucaacagcgaggacgagcaccuccuggcccuggagcggaagcucaagaagaugcuggggcccuccgccguggagaucggcaacgggugcuucgagaccaagcacaagugcaaccagaccugccuggaccgcaucgccgcgggcaccuucgacgccggggaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 88227 - RNA, 1758 nt, Artificial Sequence
  derived and/or modified sequence opt1 from hemagglutinin__InfluenzaB__AGX18368
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaagagccacuucgccaaccugaaggggaccaagacgcggggcaagcucugccccaagugccugaacugcaccgaccuggacguggcccucgggcgccccaagugcaccggcaacaccccguccgccgaggugagcauccugcacgagguccggcccgugacguccggcugcuuccccaucaugcacgaccgcaccaagauccggcagcugcccaaccuccugcgcggguacgagcacauccggcugagcaaccacaacgugaucaacgcggagaaggccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccaucuggggcuuccacagcgacaacgagacccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaagccggggaagaccggcacgaucaccuaccagcggggcauccuccugccccagaagguguggugcgccagcgggcgcuccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcggcuguccagcgccauggacgagcugcacaacgagauccucgagcuggacgagaaggucgacgaccugcgcgccgacacgaucuccagccagaucgagcucgcggugcugcuguccaacgagggcaucaucaacagcgaggacgagcaccuccuggcccuggagcggaagcucaagaagaugcuggggcccuccgccguggagaucggcaacgggugcuucgagaccaagcacaagugcaaccagaccugccuggaccgcaucgccgcgggcaccuucgacgccggggaguucagccuccccaccuucgacucccugaacaucacggccgccagccugaacgacgacggccucgacaaccacaccauccugcuguacuacuccaccgccgcgagcucccuggccgucacccucaugaucgccaucuucgugguguacauggucagccgggacaacguguccugcagcaucugccuguga

SEQ ID NO: 88228 - RNA, 1758 nt, Artificial Sequence; identical to SEQ ID NO: 87646
  derived and/or modified sequence opt1 from hemagglutinin__InfluenzaB__AGX18379

SEQ ID NO: 88229 - RNA, 1758 nt, Artificial Sequence; identical to SEQ ID NO: 88182
  derived and/or modified sequence opt1 from hemagglutinin__InfluenzaB__AGX18390

SEQ ID NO: 88230 - RNA, 1758 nt, Artificial Sequence
  derived and/or modified sequence opt1 from hemagglutinin__InfluenzaB__AGX18401
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccgcccccaccaagagccacuucgccaaccugaaggggaccaagacgcggggcaagcucugccccaagugccugaacugcaccgaccuggacguggcccucgggcgccccaagugcaccggcaacaucccguccgccgaggugagcauccugcacgagguccggcccgugaccuccggcugcuuccccaucaugcacgaccgcacgaagauccggcagcugcccaaccuccugcgcggguacgagcacauccggcugagcacccacaacgugaucaacgcggagaaggccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguacaucugcacggagggggaggaccagaucaccaucuggggcuuccacagcgacaacgagauccagauggccaagcuguacggggacuccaagccccagaaguucaccagcuccgccaacggcgucaccacgcacuacgugagccagaucggcggguuccccaaccagaccgaggacggcgggcugccccaguccggccgcaucguggucgacuacauggugcagaagccggggaagaccggcaccaucacguaccagcggggcauccuccugccccagaagguguggugcgccagcgggcgcuccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcggcuguccagcgccauggacgagcugcacaacgagauccucgagcuggacgagaaggucgacgaccugcgcgccgacaccaucuccagccagaucgagcucgcggugcugcuguccaacgagggcaucaucaacagcgaggacgagcaccuccuggcccuggagcggaagcucaagaagaugcuggggcccuccgccguggagaucggcaacgggugcuucgagacgaagcacaagugcaaccagaccugccuggaccgcaucgccgcgggcaccuucgacgccggggaguucagccuccccaccuucgacucccugaacaucaccgccgccagccugaacgacgacggccucgacaaccacacgauccugcuguacuacuccaccgccgcgagcucccuggccgucacccucaugaucgccaucuucgugguguacauggucagccgggacaacguguccugcagcaucugccuguga

SEQ ID NO: 88231 - RNA, 1758 nt, Artificial Sequence
  derived and/or modified sequence opt1 from hemagglutinin__InfluenzaB__AGX18412
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcaaccacaacgugaucaacgccgagaaggcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccaucuggggcuuccacagcgacaacgaggcccagauggccaagcuguacggggacuccaagccccagaaguucaccagcuccgccaacggcgucaccacgcacuacgugagccagaucggcggguuccccaaccagaccgaggacggcgggcugccccaguccggccgcaucguggucgacuacauggugcagaaguccgggaagaccggcaccaucacguaccagcggggcauccuccugccgcagaagguguggugcgccuccgggcgcagcaaggucaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccggccgcccgccaagcugcucaaggagcgcggcuucuucggggcgaucgccggcuuccuggagggcgggugggagggcaugaucgccggguggcacggcuacacgagccacggggcccacggcguggccgucgcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgcggugcugcuguccaacgaggggaucaucaacagcgaggacgagcaccuccuggcccuggagcggaagcucaagaagaugcugggccccuccgccguggagaucgggaacggcugcuucgagacgaagcacaagugcaaccagaccugccuggaccgcaucgccgcggggaccuucgacgccggcgaguucagccuccccaccuucgacucccugaacaucaccgccgccagccugaacgacgacggccucgacaaccacacgauccugcuguacuacuccaccgccgcgagcucccuggccgucacccucaugaucgccaucuucgugguguacauggucagccgggacaacguguccugcagcaucugccuguga

SEQ ID NO: 88232 - RNA, 1758 nt, Artificial Sequence; identical to SEQ ID NO: 87989
  derived and/or modified sequence opt1 from hemagglutinin__InfluenzaB__AGX18423

SEQ ID NO: 88233 - RNA, 1755 nt, Artificial Sequence
  derived and/or modified sequence opt1 from hemagglutinin__InfluenzaB__AGX18424
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaucaagucccacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggcccucggcgggccguaccggcugggcaccuccgggagcugccccaacgccacguccaagagcggcuucuucgccaccauggcgugggccguccccaaggacaacaacaagaacgccaccaacccccugaccguggaggugccguacaucugcacggagggcgaggaccagaucaccgucuggggguuccacuccgacgacaagacccagaugaagaaccucuacggcgacagcaacccccagaaguucaccuccagcgccaacggggugacgacccacuacgugucccagaucggcggcuuccccgaccagaccgaggacgggggccugccccagagcgggcgcaucgucguggacuacauggugcagaagccgggcaagaccgggacgaucgucuaccagcggggcgugcugcucccccagaagguguggugcgccuccggccgcagcaaggucaucaaggggagccugccccugaucggcgaggcggacugccuccacgagaaguacgggggccugaacaaguccaagcccuacuacaccggggagcacgccaaggccaucggcaacugcccgaucugggugaagacgccccugaagcucgccaacggcaccaaguaccggccgcccgccaagcugcugaaggagcgcggguucuucggcgcgaucgccggguuccucgagggcgggugggagggcaugaucgccggcuggcacggguacaccagccacggcgcccacggggucgccguggcggccgaccugaaguccacccaggaggccaucaacaagaucaccaagaaccugaacagccucuccgagcuggaggugaagaaccugcagcggcucagcggcgccauggacgagcugcacaacgagauccuggagcucgacgagaaggucgacgaccugcgcgccgacaccaucuccagccagaucgagcuggcggugcuccuguccaacgagggcaucaucaacagcgaggacgagcaccuccuggcccuggagcggaagcugaagaagaugcucgggcccuccgccguggacaucggcaacgggugcuucgagacgaagcacaagugcaaccagaccugccuggaccgcaucgccgcgggcaccuucaacgccggggaguucagccugcccaccuucgacucccucaacaucaccgccgccagccugaacgacgacggccuggacaaccacacgauccugcucuacuacuccaccgccgcgagcucccuggccgucacccugaugcucgccaucuucaucguguacauggugagccgggacaacgucuccugcagcaucugccuguga

SEQ ID NO: 88234 - RNA, 1758 nt, Artificial Sequence
  derived and/or modified sequence opt1 from hemagglutinin__InfluenzaB__AGX18435
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagauccagauggccaagcuguacggggacuccaagccccagaaguucaccagcuccgccaacggcgucacgacccacuacgugagccagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggucacccucaugaucgccaucuucgugguguacauggucagccgggacaacguguccugcagcaucugccuguga

SEQ ID NO: 88235 - RNA, 1758 nt, Artificial Sequence; identical to SEQ ID NO: 87646
  derived and/or modified sequence opt1 from hemagglutinin__InfluenzaB__AGX18446

SEQ ID NO: 88236 - RNA, 1758 nt, Artificial Sequence; identical to SEQ ID NO: 88182
  derived and/or modified sequence opt1 from hemagglutinin__InfluenzaB__AGX18457

SEQ ID NO: 88237 - RNA, 1758 nt, Artificial Sequence; identical to SEQ ID NO: 87989
  derived and/or modified sequence opt1 from hemagglutinin__InfluenzaB__AGX18468

SEQ ID NO: 88238 - RNA, 1758 nt, Artificial Sequence; identical to SEQ ID NO: 88182
  derived and/or modified sequence opt1 from hemagglutinin__InfluenzaB__AGX18479

SEQ ID NO: 88239 - RNA, 1758 nt, Artificial Sequence; identical to SEQ ID NO: 87522
  derived and/or modified sequence opt1 from hemagglutinin__InfluenzaB__AGX18490

SEQ ID NO: 88240 - RNA, 1758 nt, Artificial Sequence
  derived and/or modified sequence opt1 from hemagglutinin__InfluenzaB__AGX18512
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggccgccucugccccaagugccugaacugcaccgaccuggacguggcccucgggcggcccaagugcaccggcaacaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88241 - RNA, 1758 nt, Artificial Sequence; identical to SEQ ID NO: 87522
  derived and/or modified sequence opt1 from hemagglutinin__InfluenzaB__AGX18523

SEQ ID NO: 88242 - RNA, 1758 nt, Artificial Sequence; identical to SEQ ID NO: 87522
  derived and/or modified sequence opt1 from hemagglutinin__InfluenzaB__AGX18534

SEQ ID NO: 88243 - RNA, 1758 nt, Artificial Sequence; identical to SEQ ID NO: 87583
  derived and/or modified sequence opt1 from hemagglutinin__InfluenzaB__AGX18545

SEQ ID NO: 88244 - RNA, 1758 nt, Artificial Sequence; identical to SEQ ID NO: 87522
  derived and/or modified sequence opt1 from hemagglutinin__InfluenzaB__AGX18556

SEQ ID NO: 88245 - RNA, 1758 nt, Artificial Sequence; identical to SEQ ID NO: 87522
  derived and/or modified sequence opt1 from hemagglutinin__InfluenzaB__AGX18567

SEQ ID NO: 88246 - RNA, 1758 nt, Artificial Sequence
  derived and/or modified sequence opt1 from hemagglutinin__InfluenzaB__AGX18578
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaaggagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88247 - RNA, 1758 nt, Artificial Sequence
  derived and/or modified sequence opt1 from hemagglutinin__InfluenzaB__AGX18589
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaccgagacgcagauggccaagcuguacggggacuccaagccccagaaguucaccagcuccgccaacggcgugaccacccacuacgugagccagaucggcgacuuccccaaccagacggaggacgggggccugccccaguccgggcggaucgucguggacuacauggugcagaaguccggcaagaccgggaccaucaccuaccagcgcggcauccuccugccgcagaaggucuggugcgccuccggccggagcaaggugaucaaggggagccugccccucaucggcgaggccgacugccugcacgagaaguacgggggccugaacaaguccaagcccuacuacacgggggagcacgcgaaggccaucggcaacugccccaucugggugaagaccccgcucaagcuggccaacggcaccaaguaccgcccgcccgccaagcugcucaaggagcggggguucuucggcgccaucgcgggguuccuggagggcgggugggagggcaugaucgccggcuggcacggguacaccagccacggcgcccacggggucgccguggccgcggaccugaaguccacgcaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcacguucgacgcgggggaguucagccuccccaccuucgacucccugaacaucaccgccgccagccugaacgacgacggccucgacaaccacaccauccugcuguacuacuccacggccgccagcucccuggcggugacccucaugaucgccaucuucguggucuacauggugagccgcgacaacguguccugcagcaucugccuguga

SEQ ID NO: 88248 - RNA, 1758 nt, Artificial Sequence; identical to SEQ ID NO: 87522
  derived and/or modified sequence opt1 from hemagglutinin__InfluenzaB__AGX18600

SEQ ID NO: 88249 - RNA, 1758 nt, Artificial Sequence; identical to SEQ ID NO: 87522
  derived and/or modified sequence opt1 from hemagglutinin__InfluenzaB__AGX18611

SEQ ID NO: 88250 - RNA, 1758 nt, Artificial Sequence; identical to SEQ ID NO: 87522
  derived and/or modified sequence opt1 from hemagglutinin__InfluenzaB__AGX18622

SEQ ID NO: 88251 - RNA, 1758 nt, Artificial Sequence; identical to SEQ ID NO: 87522
  derived and/or modified sequence opt1 from hemagglutinin__InfluenzaB__AGX18633

SEQ ID NO: 88252 - RNA, 1758 nt, Artificial Sequence; identical to SEQ ID NO: 87522
  derived and/or modified sequence opt1 from hemagglutinin__InfluenzaB__AGX18644

SEQ ID NO: 88253 - RNA, 1758 nt, Artificial Sequence; identical to SEQ ID NO: 87522
  derived and/or modified sequence opt1 from hemagglutinin__InfluenzaB__AGX18655

SEQ ID NO: 88254 - RNA, 1758 nt, Artificial Sequence; identical to SEQ ID NO: 87522
  derived and/or modified sequence opt1 from hemagglutinin__InfluenzaB__AGX18666

SEQ ID NO: 88255 - RNA, 1758 nt, Artificial Sequence; identical to SEQ ID NO: 87522
  derived and/or modified sequence opt1 from hemagglutinin__InfluenzaB__AGX18677

SEQ ID NO: 88256 - RNA, 1758 nt, Artificial Sequence; identical to SEQ ID NO: 87522
  derived and/or modified sequence opt1 from hemagglutinin__InfluenzaB__AGX18688

SEQ ID NO: 88257 - RNA, 1758 nt, Artificial Sequence; identical to SEQ ID NO: 87522
  derived and/or modified sequence opt1 from hemagglutinin__InfluenzaB__AGX18699

SEQ ID NO: 88258 - RNA, 1758 nt, Artificial Sequence; identical to SEQ ID NO: 87522
  derived and/or modified sequence opt1 from hemagglutinin__InfluenzaB__AGX18710

SEQ ID NO: 88259 - RNA, 1758 nt, Artificial Sequence; identical to SEQ ID NO: 87522
  derived and/or modified sequence opt1 from hemagglutinin__InfluenzaB__AGX18721

SEQ ID NO: 88260 - RNA, 1758 nt, Artificial Sequence; identical to SEQ ID NO: 87522
  derived and/or modified sequence opt1 from hemagglutinin__InfluenzaB__AGX18732

SEQ ID NO: 88261 - RNA, 1758 nt, Artificial Sequence
  derived and/or modified sequence opt1 from hemagglutinin__InfluenzaB__AGX18743
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcaaccacaacgugaucaacgccgagaacgcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88262 - RNA, 1758 nt, Artificial Sequence; identical to SEQ ID NO: 87522
  derived and/or modified sequence opt1 from hemagglutinin__InfluenzaB__AGX18754

SEQ ID NO: 88263 - RNA, 1758 nt, Artificial Sequence; identical to SEQ ID NO: 87522
  derived and/or modified sequence opt1 from hemagglutinin__InfluenzaB__AGX18765

SEQ ID NO: 88264 - RNA, 1758 nt, Artificial Sequence; identical to SEQ ID NO: 87573
  derived and/or modified sequence opt1 from hemagglutinin__InfluenzaB__AGX18776

SEQ ID NO: 88265 - RNA, 1758 nt, Artificial Sequence; identical to SEQ ID NO: 87522
  derived and/or modified sequence opt1 from hemagglutinin__InfluenzaB__AGX18787

SEQ ID NO: 88266 - RNA, 1758 nt, Artificial Sequence; identical to SEQ ID NO: 87522
  derived and/or modified sequence opt1 from hemagglutinin__InfluenzaB__AGX18798

SEQ ID NO: 88267 - RNA, 1758 nt, Artificial Sequence
  derived and/or modified sequence opt1 from hemagglutinin__InfluenzaB__AGX18809
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacuccgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacaugaugcagaaguccgggaagacgggcaccaucaccuaccagcgcggcauccuccugccgcagaagguguggugcgccagcgggcggagcaaggucaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcagcaucugccuguga

SEQ ID NO: 88268 - RNA, 1758 nt, Artificial Sequence; identical to SEQ ID NO: 88185
  derived and/or modified sequence opt1 from hemagglutinin__InfluenzaB__AGX18820

SEQ ID NO: 88269 - RNA, 1758 nt, Artificial Sequence; identical to SEQ ID NO: 87522
  derived and/or modified sequence opt1 from hemagglutinin__InfluenzaB__AGX18831

SEQ ID NO: 88270 - RNA, 1758 nt, Artificial Sequence; identical to SEQ ID NO: 87522
  derived and/or modified sequence opt1 from hemagglutinin__InfluenzaB__AGX18842

SEQ ID NO: 88271 - RNA, 1758 nt, Artificial Sequence; identical to SEQ ID NO: 87590
  derived and/or modified sequence opt1 from hemagglutinin__InfluenzaB__AGX18853

SEQ ID NO: 88272 - RNA, 1758 nt, Artificial Sequence
  derived and/or modified sequence opt1 from hemagglutinin__InfluenzaB__AGX18864
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcaaccacaacgugaucaacgccgagaacgcgccgggcgggcccuacaagaucggcaccuccgggagcugccccaacgucaccaacggcaacggcuucuucgccacgauggccugggccgugcccaagaacgacaacaacaagaccgcgaccaacucccucaccaucgaggugccguacaucugcacggagggggaggaccagaucaccgucuggggcuuccacagcgacaacgaggcccagauggccaagcuguacggggacuccaagccccagaaguucaccagcuccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucgacgccggcgaguucagccuccccaccuucgacucccugaacaucaccgccgccagccugaacgacgacggccucgacaaccacacgauccugcuguacuacuccaccgccgcgagcucccuggccgugacccucaugaucgccaucuucguggucuacauggugagccgcgacaacguguccugcagcaucugccuguga

SEQ ID NO: 88273 - RNA, 1758 nt, Artificial Sequence
  derived and/or modified sequence opt1 from hemagglutinin__InfluenzaB__AGX18875
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaaccggaacggcuucuucgccaccauggccugggccgugcccaagaacgacaacaacaagaccgcgaccaacucccucacgaucgaggugccguacaucugcaccgagggcgaggaccagaucaccgucuggggguuccacagcgacaacgagauccagauggccaagcuguacggcgacuccaagccccagaaguucaccagcuccgccaacggggugacgacccacuacgugagccagaucggcggcuuccccaaccagaccgaggacgggggccugccccaguccgggcgcaucgucguggacuacauggugcagaaguccggcaagaccgggacgaucaccuaccagcggggcauccuccugccgcagaaggucuggugcgccuccggccgcagcaaggugaucaaggggagccugccccucaucggcgaggccgacugccugcacgagaaguacgggggccugaacaaguccaagcccuacuacaccggggagcacgcgaaggccaucggcaacugccccaucugggugaagaccccgcucaagcuggccaacggcacgaaguaccggccgcccgccaagcugcucaaggagcgcggguucuucggcgccaucgcgggguuccuggagggcgggugggagggcaugaucgccggcuggcacggguacaccagccacggcgcccacggggucgccguggccgcggaccugaaguccacccaggaggccaucaacaagaucaccaagaaccucaacagccuguccgagcuggaggucaagaaccuccagcggcugagcggcgccaucgacgagcugcacaacgagauccucgagcuggacgagaagguggacgaccugcgcgccgacacgaucuccagccagaucgagcucgccgugcugcuguccaacgagggcaucaucaacagcgaggacgagcaccuccuggcgcuggagcggaagcucaagaagaugcuggggcccuccgccgucgagaucggcaacgggugcuucgagaccaagcacaagugcaaccagaccugccuggaccgcaucgccgccggcaccuucgacgcgggggaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88274 - RNA, 1758 nt, Artificial Sequence
  derived and/or modified sequence opt1 from hemagglutinin__InfluenzaB__AGX18886
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagauccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacaacggccucgacaaccacaccauccugcuguacuacuccaccgccgccagcucccuggcggugacccucaucaucgccaucuucguggucuacauggugagccgcgacaacguguccugcagcaucugccuguga

SEQ ID NO: 88275 - RNA, 1758 nt, Artificial Sequence; identical to SEQ ID NO: 87995
  derived and/or modified sequence opt1 from hemagglutinin__InfluenzaB__AGX18897

SEQ ID NO: 88276 - RNA, 1758 nt, Artificial Sequence; identical to SEQ ID NO: 87522
  derived and/or modified sequence opt1 from hemagglutinin__InfluenzaB__AGX18908

SEQ ID NO: 88277 - RNA, 1758 nt, Artificial Sequence; identical to SEQ ID NO: 87522
  derived and/or modified sequence opt1 from hemagglutinin__InfluenzaB__AGX18919

SEQ ID NO: 88278 - RNA, 1758 nt, Artificial Sequence
  derived and/or modified sequence opt1 from hemagglutinin__InfluenzaB__AGX18930
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugcaucgaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 88279 - RNA, 1758 nt, Artificial Sequence; identical to SEQ ID NO: 87522
  derived and/or modified sequence opt1 from hemagglutinin__InfluenzaB__AGX18941

SEQ ID NO: 88280 - RNA, 1758 nt, Artificial Sequence; identical to SEQ ID NO: 87522
  derived and/or modified sequence opt1 from hemagglutinin__InfluenzaB__AGX18952

SEQ ID NO: 88281 - RNA, 1758 nt, Artificial Sequence; identical to SEQ ID NO: 87522
  derived and/or modified sequence opt1 from hemagglutinin__InfluenzaB__AGX18963

SEQ ID NO: 88282 - RNA, 1758 nt, Artificial Sequence
  derived and/or modified sequence opt1 from hemagglutinin__InfluenzaB__AGX18974
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagaagaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 88283 - RNA, 1758 nt, Artificial Sequence; identical to SEQ ID NO: 87522
  derived and/or modified sequence opt1 from hemagglutinin__InfluenzaB__AGX18985

SEQ ID NO: 88284 - RNA, 1758 nt, Artificial Sequence
  derived and/or modified sequence opt1 from hemagglutinin__InfluenzaB__AGX18996
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacacgccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacgucaccaacggcaacggcuucuucgccaccauggccugggccgugcccaagaacgacaacaacaagaccgcgacgaacucccucaccaucgaggugccguacaucugcaccgagggggaggaccagaucaccgucuggggcuuccacagcgacaacgggacgcagauggccaagcuguacggcgacuccaagccccagaaguucaccagcuccgccaacggcgugaccacccacuacgugagccagaucgggggcuuccccaaccagacggaggacgggggccugccccaguccgggcggaucgucguggacuacauggugcagaaguccggcaagaccggcaccaucaccuaccagcgcgggauccuccugccgcagaaggucuggugcgccuccggccggagcaaggugaucaaggggagccugccccucaucggcgaggccgacugccugcacgagaaguacgggggccugaacaaguccaagcccuacuacacgggcgagcacgcgaaggccaucgggaacugccccaucugggugaagaccccgcucaagcuggccaacggcaccaaguaccgcccgcccgccaagcugcucaaggagcggggguucuucggcgccaucgcgggguuccuggagggcggcugggaggggaugaucgccggcuggcacggguacaccagccacggcgcccacggcgucgccguggccgcggaccugaaguccacgcaggaggccaucaacaagaucaccaagaaccucaacagccuguccgagcuggaggucaagaaccuccagcgccugagcggggccauggacgagcugcacaacgagauccucgagcuggacgagaagguggacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcacguucgacgcgggcgaguucagccuccccaccuucgacucccugaacaucaccgccgccagccugaacgacgacgggcucgacaaccacaccauccugcuguacuacuccacggccgccagcucccuggcggugacccucaugaucgccaucuucguggucuacauggugagccgcgacaacguguccugcagcaucugccuguga

SEQ ID NO: 88285 - RNA, 1758 nt, Artificial Sequence; identical to SEQ ID NO: 87522
  derived and/or modified sequence opt1 from hemagglutinin__InfluenzaB__AGX19007

SEQ ID NO: 88286 - RNA, 1758 nt, Artificial Sequence
  derived and/or modified sequence opt1 from hemagglutinin__InfluenzaB__AGX19018
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaacuuccuccggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacagcgacuccgagacccagauggccaagcucuacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccugcucccgcagaaggucuggugcgccagcgggcggagcaaggugaucaagggcucccugccccugaucggggaggccgacugccuccacgagaaguacggcgggcugaacaagagcaagcccuacuacaccggcgagcacgcgaaggccaucggcaacugccccaucugggugaagacgccgcugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcagcaucugccucuga

SEQ ID NO: 88287 - RNA, 1758 nt, Artificial Sequence; identical to SEQ ID NO: 88185
  derived and/or modified sequence opt1 from hemagglutinin__InfluenzaB__AGX19029

SEQ ID NO: 88288 - RNA, 1758 nt, Artificial Sequence; identical to SEQ ID NO: 87522
  derived and/or modified sequence opt1 from hemagglutinin__InfluenzaB__AGX19040

SEQ ID NO: 88289 - RNA, 1758 nt, Artificial Sequence
  derived and/or modified sequence opt1 from hemagglutinin__InfluenzaB__AGX19051
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacaccgagaacgccccgggcgggcccuacaagaucggcacguccgggagcugccccaacgucaccaacggcaacggcuucuucgcgaccauggccugggccgugcccaagaacgacaacaacaagaccgccacgaacucccucaccaucgaggugccguacaucugcaccgagggggaggaccagaucaccgucuggggcuuccacagcgacuccgagacgcagauggcgaagcuguacggggacagcaagccccagaaguucaccuccagcgccaacggcgugaccacccacuacgugucccagaucggcggguuccccaaccagacggaggacggcgggcugccccagagcggccggaucgucguggacuacauggugcagaaguccgggaagaccggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacgcaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcagcaucugccuguga

SEQ ID NO: 88290 - RNA, 1758 nt, Artificial Sequence
  derived and/or modified sequence opt1 from hemagglutinin__InfluenzaB__AGX19062
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaacuucaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 88291 - RNA, 1758 nt, Artificial Sequence; identical to SEQ ID NO: 87522
  derived and/or modified sequence opt1 from hemagglutinin__InfluenzaB__AGX19073

SEQ ID NO: 88292 - RNA, 1758 nt, Artificial Sequence
  derived and/or modified sequence opt1 from hemagglutinin__InfluenzaB__AGX19084
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacaucaagcugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccagcuccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcggcugagcggcgccauggacgagcugcacaacgagauccucgagcuggacgagaagguggacgaccugcgcgccgacacgaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgggacaacguguccugcagcaucugccuguga

SEQ ID NO: 88293 - RNA, 1758 nt, Artificial Sequence; identical to SEQ ID NO: 87522
  derived and/or modified sequence opt1 from hemagglutinin__InfluenzaB__AGX19095

SEQ ID NO: 88294 - RNA, 1758 nt, Artificial Sequence; identical to SEQ ID NO: 88185
  derived and/or modified sequence opt1 from hemagglutinin__InfluenzaB__AGX19106

SEQ ID NO: 88295 - RNA, 1758 nt, Artificial Sequence; identical to SEQ ID NO: 87522
  derived and/or modified sequence opt1 from hemagglutinin__InfluenzaB__AGX19117

SEQ ID NO: 88296 - RNA, 1758 nt, Artificial Sequence
  derived and/or modified sequence opt1 from hemagglutinin__InfluenzaB__AGX19128
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacacgccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacgucaccaacggcaacggcuucuucgccaccauggccugggccgugcccaagaacgacaacaacaagaccgcgacgaacucccucaccaucgaggugccguacaucugcaccgagggggaggaccagaucaccgucuggggcuuccacagcgacuccgagacgcagauggccaagcuguacggggacagcaagccccagaaguucaccuccagcgccaacggcgugaccacccacuacgugucccagaucggcggguuccccaaccagacggaggacggcgggcugccccagagcggccggaucgucguggacuacauggugcagaaguccgggaagaccggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacgcaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcagcaucugccuguga

SEQ ID NO: 88297 - RNA, 1758 nt, Artificial Sequence; identical to SEQ ID NO: 87522
  derived and/or modified sequence opt1 from hemagglutinin__InfluenzaB__AGX19139

SEQ ID NO: 88298 - RNA, 1758 nt, Artificial Sequence; identical to SEQ ID NO: 87995
  derived and/or modified sequence opt1 from hemagglutinin__InfluenzaB__AGX19150

SEQ ID NO: 88299 - RNA, 1758 nt, Artificial Sequence; identical to SEQ ID NO: 87522
  derived and/or modified sequence opt1 from hemagglutinin__InfluenzaB__AGX19161

SEQ ID NO: 88300 - RNA, 1758 nt, Artificial Sequence; identical to SEQ ID NO: 87995
  derived and/or modified sequence opt1 from hemagglutinin__InfluenzaB__AGX19172

SEQ ID NO: 88301 - RNA, 1758 nt, Artificial Sequence
  derived and/or modified sequence opt1 from hemagglutinin__InfluenzaB__AGX19183
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaccgagacgcagauggccaagcuguacggggacuccaagccccagaaguucaccagcuccgccaacggcgugaccacccacuacgugagccagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacgcaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggacguucgacgcgggcgaguucagccuccccaccuucgacucccugaacaucaccgccgccagccugaacgacgacggccucgacaaccacaccauccugcuguacuacuccacggccgccagcucccuggcggugacccucaugaucgccaucuucguggucuacauggugagccgcgacaacguguccugcagcaucugccuguga

SEQ ID NO: 88302 - RNA, 1758 nt, Artificial Sequence; identical to SEQ ID NO: 87522
  derived and/or modified sequence opt1 from hemagglutinin__InfluenzaB__AGX19194

SEQ ID NO: 88303 - RNA, 1758 nt, Artificial Sequence
  derived and/or modified sequence opt1 from hemagglutinin__InfluenzaB__AGX19205
augaaggccaucaucgugcugcucauggucgugaccagcaacgccgaccgcgugugcaccggcaucacguccagcaacagcccccacgucgugaagaccgcgacccagggggaggugaacgucaccggcgugaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggucagcauccugcacgaggugcgccccgugacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacgugacgaacggcaacggcuucuucgccaccauggccugggccgugcccaagaacgacaacaacaagaccgcgaccaacucccucacgaucgaggucccguacaucugcaccgagggggaggaccagaucaccguguggggcuuccacagcgacaacgagacccagauggccaagcuguacggggacuccaagccccagaaguucacgagcuccgccaacggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgcgacaacgucuccugcagcaucugccuguga

SEQ ID NO: 88304 - RNA, 1758 nt, Artificial Sequence
  derived and/or modified sequence opt1 from hemagglutinin__InfluenzaB__AGX19216
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagccgggcacgaucaccuaccagcgcggcauccuccugccccagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88305 - RNA, 1758 nt, Artificial Sequence
  derived and/or modified sequence opt1 from hemagglutinin__InfluenzaB__AGX19227
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugcccccagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaaguccgacaacaacaagaccgcgaccaacagccucacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcggagcaaggugaucaagggcucccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcagcaucugccuguga

SEQ ID NO: 88306 - RNA, 1758 nt, Artificial Sequence
  derived and/or modified sequence opt1 from hemagglutinin__InfluenzaB__AGX19238
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88307 - RNA, 1758 nt, Artificial Sequence; identical to SEQ ID NO: 88306
  derived and/or modified sequence opt1 from hemagglutinin__InfluenzaB__AGX19249

SEQ ID NO: 88308 - RNA, 1758 nt, Artificial Sequence; identical to SEQ ID NO: 87522
  derived and/or modified sequence opt1 from hemagglutinin__InfluenzaB__AGX19260

SEQ ID NO: 88309 - RNA, 1758 nt, Artificial Sequence; identical to SEQ ID NO: 87522
  derived and/or modified sequence opt1 from hemagglutinin__InfluenzaB__AGX19271

SEQ ID NO: 88310 - RNA, 1758 nt, Artificial Sequence
  derived and/or modified sequence opt1 from hemagglutinin__InfluenzaB__AGX19282
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcaccuccgggcggagcaaggugaucaagggcagccugccccucaucggggaggccgacugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacgcaggaggcgaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcccuggagcgcaagcucaagaagaugcugggccccuccgcggucgagaucgggaacggcugcuucgagaccaagcacaagugcaaccagaccugccuggaccggaucgccgccgggacguucgacgccggcgaguucagccuccccaccuucgacucccugaacaucaccgcggccagccugaacgacgacggccucgacaaccacaccauccugcuguacuacuccacggccgccagcucccuggccgugacccucaugaucgcgaucuucguggucuacauggugagccgcgacaacguguccugcagcaucugccuguga

SEQ ID NO: 88311 - RNA, 1758 nt, Artificial Sequence
  derived and/or modified sequence opt1 from hemagglutinin__InfluenzaB__AGX19304
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaucaacucccucaccaucgaggugccguacaucugcacggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88312 - RNA, 1758 nt, Artificial Sequence; identical to SEQ ID NO: 88311
  derived and/or modified sequence opt1 from hemagglutinin__InfluenzaB__AGX19315

SEQ ID NO: 88313 - RNA, 1758 nt, Artificial Sequence; identical to SEQ ID NO: 88310
  derived and/or modified sequence opt1 from hemagglutinin__InfluenzaB__AGX19326

SEQ ID NO: 88314 - RNA, 1758 nt, Artificial Sequence; identical to SEQ ID NO: 88310
  derived and/or modified sequence opt1 from hemagglutinin__InfluenzaB__AGX19337

SEQ ID NO: 88315 - RNA, 1758 nt, Artificial Sequence
  derived and/or modified sequence opt1 from hemagglutinin__InfluenzaB__AGX19348
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcaccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88316 - RNA, 1758 nt, Artificial Sequence; identical to SEQ ID NO: 88310
  derived and/or modified sequence opt1 from hemagglutinin__InfluenzaB__AGX19359

SEQ ID NO: 88317 - RNA, 1755 nt, Artificial Sequence; identical to SEQ ID NO: 87739
  derived and/or modified sequence opt1 from hemagglutinin__InfluenzaB__AGX19370

SEQ ID NO: 88318 - RNA, 1758 nt, Artificial Sequence; identical to SEQ ID NO: 87573
  derived and/or modified sequence opt1 from hemagglutinin__InfluenzaB__AGX19381

SEQ ID NO: 88319 - RNA, 1758 nt, Artificial Sequence; identical to SEQ ID NO: 88310
  derived and/or modified sequence opt1 from hemagglutinin__InfluenzaB__AGX19392

SEQ ID NO: 88320 - RNA, 1758 nt, Artificial Sequence; identical to SEQ ID NO: 88310
  derived and/or modified sequence opt1 from hemagglutinin__InfluenzaB__AGX19403

SEQ ID NO: 88321 - RNA, 1758 nt, Artificial Sequence; identical to SEQ ID NO: 87997
  derived and/or modified sequence opt1 from hemagglutinin__InfluenzaB__AGX19414

SEQ ID NO: 88322 - RNA, 1755 nt, Artificial Sequence
  derived and/or modified sequence opt1 from hemagglutinin__InfluenzaB__AGX19425
augaagaccaucaucgugcugcucauggucgugaccagcaacgccgaccgcaucugcacgggcaucaccuccagcaacagcccccacguggucaagaccgccacccagggggaggugaacgugacgggcgucaucccgcugaccaccacccccacgaaguccuacuucgcgaaccugaaggggacccggacccgcggcaagcucugccccgacugccugaacugcaccgaccuggacguggcccucgggcggcccaugugcgugggcacgaccccguccgccaaggccagcauccugcacgagguccgccccgugaccuccggcugcuuccccaucaugcacgaccggaccaagauccgccagcugcccaaccuccugcggggguacgagaacauccgccugagcacgcagaacgugaucgacgccgagaaggcgccgggcgggcccuaccggcucggcaccuccgggagcugccccaacgccaccuccaagagcggcuucuucgccaccauggccugggcgguccccaaggacaacaacaagaacgccacgaacccgcugaccguggaggugcccuacaucugcaccgagggcgaggaccagaucaccgucuggggguuccacuccgacaacaagacgcagaugcgcaaccuguacggcgacagcaacccccagaaguucaccuccagcgccaacggggugaccacccacuacgugucccagaucggcagcuuccccgaccagacggaggacggcgggcucccgcaguccggccggaucgucguggacuacaugaugcagaagcccgggaagaccggcaccaucguguaccagcgcgggguccugcugccccagcggguguggugcgccagcggccgcagcaaggugaucaagggcgcccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggagaucgggaacggcugcuucgagaccaagcacaagugcaaccagaccugccucgaccgcaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugcuggccaucuucaucgucuacauggugagccgggacaacguguccugcagcaucugccucuga

SEQ ID NO: 88323 - RNA, 1758 nt, Artificial Sequence; identical to SEQ ID NO: 87522
  derived and/or modified sequence opt1 from hemagglutinin__InfluenzaB__AGX19436

SEQ ID NO: 88324 - RNA, 1758 nt, Artificial Sequence; identical to SEQ ID NO: 88185
  derived and/or modified sequence opt1 from hemagglutinin__InfluenzaB__AGX19447

SEQ ID NO: 88325 - RNA, 1755 nt, Artificial Sequence; identical to SEQ ID NO: 88064
  derived and/or modified sequence opt1 from hemagglutinin__InfluenzaB__AGX19458

SEQ ID NO: 88326 - RNA, 1755 nt, Artificial Sequence; identical to SEQ ID NO: 88064
  derived and/or modified sequence opt1 from hemagglutinin__InfluenzaB__AGX19469

SEQ ID NO: 88327 - RNA, 1758 nt, Artificial Sequence; identical to SEQ ID NO: 87997
  derived and/or modified sequence opt1 from hemagglutinin__InfluenzaB__AGX19480

SEQ ID NO: 88328 - RNA, 1758 nt, Artificial Sequence; identical to SEQ ID NO: 87590
  derived and/or modified sequence opt1 from hemagglutinin__InfluenzaB__AGX19491

SEQ ID NO: 88329 - RNA, 1758 nt, Artificial Sequence
  derived and/or modified sequence opt1 from hemagglutinin__InfluenzaB__AGX19502
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacagcgagacccagauggccaagcuguacggggacuccaagccccagaaguucacgagcuccgccaacggcgucaccacccacuacgugagccagaucggcggguuccccaaccagaccgaggacggcgggcugccgcaguccggccggaucguggucgacuacauggugcagaaguccgggaagacgggcaccaucaccuaccagcgcggcauccuccugccccagaagguguggugcgccuccgggcggagcaaggucaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 88330 - RNA, 1758 nt, Artificial Sequence
  derived and/or modified sequence opt1 from hemagglutinin__InfluenzaB__AGX19513
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacaucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 88331 - RNA, 1758 nt, Artificial Sequence; identical to SEQ ID NO: 88330
  derived and/or modified sequence opt1 from hemagglutinin__InfluenzaB__AGX19524

SEQ ID NO: 88332 - RNA, 1758 nt, Artificial Sequence
  derived and/or modified sequence opt1 from hemagglutinin__InfluenzaB__AGX19535
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacgacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88333 - RNA, 1758 nt, Artificial Sequence
  derived and/or modified sequence opt1 from hemagglutinin__InfluenzaB__AGX19546
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaaggagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88334 - RNA, 1758 nt, Artificial Sequence
  derived and/or modified sequence opt1 from hemagglutinin__InfluenzaB__AGX19557
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgggggcgaggaccagaucaccgucuggggguuccacagcgacaacgagacccagauggccaagcuguacggcgacuccaagccccagaaguucacgagcuccgccaacggcgugaccacccacuacgugagccagaucgggggcuuccccaaccagaccgaggacgggggccugccccaguccgggcggaucgucguggacuacauggugcagaaguccggcaagacgggcaccaucaccuaccagcgcgggauccuccugccgcagaaggucuggugcgccuccggccggagcaaggugaucaaggggagccugccccucaucggcgaggccgacugccugcacgagaaguacgggggccugaacaaguccaagcccuacuacaccggcgagcacgcgaaggccaucgggaacugccccaucugggugaagacgccgcucaagcuggccaacggcaccaaguaccgcccgcccgccaagcugcucaaggagcggggguucuucggcgccaucgcgggguuccuggagggcggcugggaggggaugaucgccggcuggcacggguacaccagccacggcgcccacggcgucgccguggccgcggaccugaaguccacccaggaggccaucaacaagaucacgaagaaccucaacagccuguccgagcuggaggucaagaaccuccagcgccugagcggggccauggacgagcugcacaacgagauccucgagcuggacgagaagguggacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcaccuucgacgcgggcgaguucagccuccccacguucgacucccugaacaucaccgccgccagccugaacgacgacgggcucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88335 - RNA, 1758 nt, Artificial Sequence; identical to SEQ ID NO: 87997
  derived and/or modified sequence opt1 from hemagglutinin__InfluenzaB__AGX19568

SEQ ID NO: 88336 - RNA, 1758 nt, Artificial Sequence; identical to SEQ ID NO: 88330
  derived and/or modified sequence opt1 from hemagglutinin__InfluenzaB__AGX19579

SEQ ID NO: 88337 - RNA, 1758 nt, Artificial Sequence; identical to SEQ ID NO: 87997
  derived and/or modified sequence opt1 from hemagglutinin__InfluenzaB__AGX19590

SEQ ID NO: 88338 - RNA, 1758 nt, Artificial Sequence; identical to SEQ ID NO: 87997
  derived and/or modified sequence opt1 from hemagglutinin__InfluenzaB__AGX19601

SEQ ID NO: 88339 - RNA, 1758 nt, Artificial Sequence; identical to SEQ ID NO: 87997
  derived and/or modified sequence opt1 from hemagglutinin__InfluenzaB__AGX19612

SEQ ID NO: 88340 - RNA, 1758 nt, Artificial Sequence
  derived and/or modified sequence opt1 from hemagglutinin__InfluenzaB__AGX19623
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcgguggcccucaugaucgccaucuucguggucuacauggugagccgcgacaacguguccugcagcaucugccuguga

SEQ ID NO: 88341 - RNA, 1758 nt, Artificial Sequence; identical to SEQ ID NO: 87997
  derived and/or modified sequence opt1 from hemagglutinin__InfluenzaB__AGX19634

SEQ ID NO: 88342 - RNA, 1758 nt, Artificial Sequence; identical to SEQ ID NO: 87522
  derived and/or modified sequence opt1 from hemagglutinin__InfluenzaB__AGX19645

SEQ ID NO: 88343 - RNA, 1758 nt, Artificial Sequence; identical to SEQ ID NO: 87573
  derived and/or modified sequence opt1 from hemagglutinin__InfluenzaB__AGX19656

SEQ ID NO: 88344 - RNA, 1758 nt, Artificial Sequence
  derived and/or modified sequence opt1 from hemagglutinin__InfluenzaB__AGX19667
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaaggaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 88345 - RNA, 1758 nt, Artificial Sequence; identical to SEQ ID NO: 87997
  derived and/or modified sequence opt1 from hemagglutinin__InfluenzaB__AGX19678

SEQ ID NO: 88346 - RNA, 1758 nt, Artificial Sequence; identical to SEQ ID NO: 87522
  derived and/or modified sequence opt1 from hemagglutinin__InfluenzaB__AGX19700

SEQ ID NO: 88347 - RNA, 1758 nt, Artificial Sequence
  derived and/or modified sequence opt1 from hemagglutinin__InfluenzaB__AGX19711
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaaggagggggaggaccagaucaccgucuggggcuuccacagcgacaacgagacccagauggccaagcuguacggggacuccaagccccagaaguucaccagcuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucguggucuacauggugagccgcgacaacguguccugcagcaucugccuguga

SEQ ID NO: 88348 - RNA, 1758 nt, Artificial Sequence; identical to SEQ ID NO: 87997
  derived and/or modified sequence opt1 from hemagglutinin__InfluenzaB__AGX19722

SEQ ID NO: 88349 - RNA, 1758 nt, Artificial Sequence; identical to SEQ ID NO: 87997
  derived and/or modified sequence opt1 from hemagglutinin__InfluenzaB__AGX19733

SEQ ID NO: 88350 - RNA, 1758 nt, Artificial Sequence; identical to SEQ ID NO: 87997
  derived and/or modified sequence opt1 from hemagglutinin__InfluenzaB__AGX19744

SEQ ID NO: 88351 - RNA, 1758 nt, Artificial Sequence; identical to SEQ ID NO: 87522
  derived and/or modified sequence opt1 from hemagglutinin__InfluenzaB__AGX19755

SEQ ID NO: 88352 - RNA, 1758 nt, Artificial Sequence; identical to SEQ ID NO: 87997
  derived and/or modified sequence opt1 from hemagglutinin__InfluenzaB__AGX19766

SEQ ID NO: 88353 - RNA, 1758 nt, Artificial Sequence; identical to SEQ ID NO: 88330
  derived and/or modified sequence opt1 from hemagglutinin__InfluenzaB__AGX19788

SEQ ID NO: 88354 - RNA, 1758 nt, Artificial Sequence; identical to SEQ ID NO: 87997
  derived and/or modified sequence opt1 from hemagglutinin__InfluenzaB__AGX19799

SEQ ID NO: 88355 - RNA, 1758 nt, Artificial Sequence; identical to SEQ ID NO: 87997
  derived and/or modified sequence opt1 from hemagglutinin__InfluenzaB__AGX19810

SEQ ID NO: 88356 - RNA, 1758 nt, Artificial Sequence
  derived and/or modified sequence opt1 from hemagglutinin__InfluenzaB__AGX19821
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcuccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcagcaucugccuguga

SEQ ID NO: 88357 - RNA, 1758 nt, Artificial Sequence; identical to SEQ ID NO: 88330
  derived and/or modified sequence opt1 from hemagglutinin__InfluenzaB__AGX19832

SEQ ID NO: 88358 - RNA, 1758 nt, Artificial Sequence; identical to SEQ ID NO: 87997
  derived and/or modified sequence opt1 from hemagglutinin__InfluenzaB__AGX19843

SEQ ID NO: 88359 - RNA, 1758 nt, Artificial Sequence; identical to SEQ ID NO: 87997
  derived and/or modified sequence opt1 from hemagglutinin__InfluenzaB__AGX19854

SEQ ID NO: 88360 - RNA, 1758 nt, Artificial Sequence; identical to SEQ ID NO: 87997
  derived and/or modified sequence opt1 from hemagglutinin__InfluenzaB__AGX19865

SEQ ID NO: 88361 - RNA, 1758 nt, Artificial Sequence; identical to SEQ ID NO: 88330
  derived and/or modified sequence opt1 from hemagglutinin__InfluenzaB__AGX19876

SEQ ID NO: 88362 - RNA, 1758 nt, Artificial Sequence; identical to SEQ ID NO: 87997
  derived and/or modified sequence opt1 from hemagglutinin__InfluenzaB__AGX19887

SEQ ID NO: 88363 - RNA, 1758 nt, Artificial Sequence
  derived and/or modified sequence opt1 from hemagglutinin__InfluenzaB__AGX19898
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacgagaacggcuucuucgccaccauggccugggccguccccaagaacgacaagaacaagaccgcgaccaacccgcucacgaucgaggugcccuacaucugcaccgagggcgaggaccagaucaccguguggggguuccacuccgacaacgagacccagauggccaagcuguacggcgacagcaagccccagaaguucacguccagcgccaacggggucaccacccacuacgugucccagaucggcggcuuccccaaccagaccgaggacgggggccugccgcagagcgggcggaucguggucgacuacauggugcagaaguccggcaagacggggaccaucaccuaccagcgcggcauccuccugccccagaagguguggugcgccagcggccgguccaaggucaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacgggguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccguggagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 88364 - RNA, 1758 nt, Artificial Sequence; identical to SEQ ID NO: 87522
  derived and/or modified sequence opt1 from hemagglutinin__InfluenzaB__AGX19909

SEQ ID NO: 88365 - RNA, 1758 nt, Artificial Sequence; identical to SEQ ID NO: 87997
  derived and/or modified sequence opt1 from hemagglutinin__InfluenzaB__AGX19920

SEQ ID NO: 88366 - RNA, 1758 nt, Artificial Sequence; identical to SEQ ID NO: 88363
  derived and/or modified sequence opt1 from hemagglutinin__InfluenzaB__AGX19931

SEQ ID NO: 88367 - RNA, 1758 nt, Artificial Sequence; identical to SEQ ID NO: 88330
  derived and/or modified sequence opt1 from hemagglutinin__InfluenzaB__AGX19942

SEQ ID NO: 88368 - RNA, 1758 nt, Artificial Sequence; identical to SEQ ID NO: 87997
  derived and/or modified sequence opt1 from hemagglutinin__InfluenzaB__AGX19953

SEQ ID NO: 88369 - RNA, 1758 nt, Artificial Sequence; identical to SEQ ID NO: 87755
  derived and/or modified sequence opt1 from hemagglutinin__InfluenzaB__AGX19964

SEQ ID NO: 88370 - RNA, 1758 nt, Artificial Sequence; identical to SEQ ID NO: 87522
  derived and/or modified sequence opt1 from hemagglutinin__InfluenzaB__AGX19975

SEQ ID NO: 88371 - RNA, 1758 nt, Artificial Sequence
  derived and/or modified sequence opt1 from hemagglutinin__InfluenzaB__AGX19986
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgucagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 88372 - RNA, 1758 nt, Artificial Sequence
  derived and/or modified sequence opt1 from hemagglutinin__InfluenzaB__AGX19997
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaucgaggacggcgggcugccgcagagcggccggaucguggucgacuacauggugcagaaguccgggaagaccggcacgaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggucacccucaugaucgccaucuucgugguguacauggucucccgcgacaacgugagcugcuccaucugccuguga

SEQ ID NO: 88373 - RNA, 1758 nt, Artificial Sequence; identical to SEQ ID NO: 87997
  derived and/or modified sequence opt1 from hemagglutinin__InfluenzaB__AGX20008

SEQ ID NO: 88374 - RNA, 1758 nt, Artificial Sequence; identical to SEQ ID NO: 87997
  derived and/or modified sequence opt1 from hemagglutinin__InfluenzaB__AGX20019

SEQ ID NO: 88375 - RNA, 1758 nt, Artificial Sequence; identical to SEQ ID NO: 87997
  derived and/or modified sequence opt1 from hemagglutinin__InfluenzaB__AGX20030

SEQ ID NO: 88376 - RNA, 1758 nt, Artificial Sequence
  derived and/or modified sequence opt1 from hemagglutinin__InfluenzaB__AGX20041
augaaggccaucaucgugcugcucauggucgugaccagcgacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggaaggagacgcggggcaagcucugccccaagugccugaacugcaccgaccuggacguggcccucgggcgccccaagugcaccggcaagaucccguccgcccgggugagcauccugcacgagguccgccccgugaccuccggcugcuuccccaucaugcacgaccggacgaagauccgccagcugcccaaccuccugcggggguacgagcacauccgccugagcacccacaacgugaucaacgccgagaacgcgccgggcgggcccuacaagaucggcaccuccgggagcugccccaacaucaccaacggcaacggcuucuucgccacgauggccugggccguccccaagaacgacaagaacaagaccgcgaccaacccgcucaccaucgaggugcccuacaucugcacggagggggaggaccagaucaccguguggggcuuccacuccgacaacgagacccagauggccaagcuguacggggacagcaagccccagaaguucaccuccagcgccaacggcgucacgacccacuacgugucccagaucggcggguuccccaaccagaccgaggacggcgggcugccgcagagcggccggaucguggucgacuacauggugcagaaguccgggaagaccggcacgaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggucacccucaugaucgccaucuucgugguguacauggucucccgcgacaacgugagcugcuccaucugccuguga

SEQ ID NO: 88377 - RNA, 1758 nt, Artificial Sequence; identical to SEQ ID NO: 87997
  derived and/or modified sequence opt1 from hemagglutinin__InfluenzaB__AGX20052

SEQ ID NO: 88378 - RNA, 1758 nt, Artificial Sequence; identical to SEQ ID NO: 87997
  derived and/or modified sequence opt1 from hemagglutinin__InfluenzaB__AGX20063

SEQ ID NO: 88379 - RNA, 1758 nt, Artificial Sequence
  derived and/or modified sequence opt1 from hemagglutinin__InfluenzaB__AGX20074
augaaggccaucaucgcccugcucaugguggucaccagcaacgcggaccgcaucugcaccggcaucacguccagcaacagcccccacguggugaagaccgccacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgcggagaacgccccgggcgggcccuacaagaucggcaccuccgggagcugccccaacaucacgaacggcaacggcuucuucgccaccauggccugggcggugcccaagaacgacaagaacaagaccgccaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggcggacugccugcacgagaaguacggcgggcugaacaagagcaagcccuacuacaccggcgagcacgccaaggccaucggcaacugcccgaucugggucaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccguggcggccgaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgcgguccugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccacguucgacagccugaacaucaccgccgccucccugaacgacgacggccucgacaaccacaccauccugcuguacuacagcaccgccgcguccagccuggccgugacgcucaugaucgccaucuucgucguguacauggugucccgcgacaacgucagcugcuccaucugccuguga

SEQ ID NO: 88380 - RNA, 1758 nt, Artificial Sequence
  derived and/or modified sequence opt1 from hemagglutinin__InfluenzaB__AGX20085
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccaucuggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 88381 - RNA, 1758 nt, Artificial Sequence
  derived and/or modified sequence opt1 from hemagglutinin__InfluenzaB__AGX20096
augaaggccaucaucgugcugcucauggucgugaccagcaacgccgaccgcaucugcaccggcgugacguccagcaacagcccccacgucgugaagaccgcgacccagggggaggugaacgucaccggcgugaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggucagcauccugcacgaggugcgccccgugacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacgugacgaacggcaacggcuucuucgccaccauggccugggccgugcccaagaacgacaacaacaagaccgcgaccaacucccucacgaucgaggucccguacaucugcaccgagggggaggaccagaucaccguguggggcuuccacagcgacaacgagacccagauggccaagcuguacggggacuccaagccccagaaguucacgagcuccgccaacggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgcgacaacgucuccugcagcaucugccuguga

SEQ ID NO: 88382 - RNA, 1758 nt, Artificial Sequence; identical to SEQ ID NO: 87616
  derived and/or modified sequence opt1 from hemagglutinin__InfluenzaB__AGX20107

SEQ ID NO: 88383 - RNA, 1758 nt, Artificial Sequence; identical to SEQ ID NO: 87616
  derived and/or modified sequence opt1 from hemagglutinin__InfluenzaB__AGX20118

SEQ ID NO: 88384 - RNA, 1758 nt, Artificial Sequence; identical to SEQ ID NO: 87616
  derived and/or modified sequence opt1 from hemagglutinin__InfluenzaB__AGX20129

SEQ ID NO: 88385 - RNA, 1758 nt, Artificial Sequence; identical to SEQ ID NO: 87616
  derived and/or modified sequence opt1 from hemagglutinin__InfluenzaB__AGX20140

SEQ ID NO: 88386 - RNA, 1758 nt, Artificial Sequence; identical to SEQ ID NO: 87616
  derived and/or modified sequence opt1 from hemagglutinin__InfluenzaB__AGX20151

SEQ ID NO: 88387 - RNA, 1758 nt, Artificial Sequence; identical to SEQ ID NO: 87616
  derived and/or modified sequence opt1 from hemagglutinin__InfluenzaB__AGX20162

SEQ ID NO: 88388 - RNA, 1758 nt, Artificial Sequence; identical to SEQ ID NO: 87616
  derived and/or modified sequence opt1 from hemagglutinin__InfluenzaB__AGX20173

SEQ ID NO: 88389 - RNA, 1758 nt, Artificial Sequence; identical to SEQ ID NO: 87616
  derived and/or modified sequence opt1 from hemagglutinin__InfluenzaB__AGX20184

SEQ ID NO: 88390 - RNA, 1758 nt, Artificial Sequence; identical to SEQ ID NO: 87616
  derived and/or modified sequence opt1 from hemagglutinin__InfluenzaB__AGX20195

SEQ ID NO: 88391 - RNA, 1758 nt, Artificial Sequence; identical to SEQ ID NO: 87616
  derived and/or modified sequence opt1 from hemagglutinin__InfluenzaB__AGX20206

SEQ ID NO: 88392 - RNA, 1758 nt, Artificial Sequence; identical to SEQ ID NO: 87616
  derived and/or modified sequence opt1 from hemagglutinin__InfluenzaB__AGX20217

SEQ ID NO: 88393 - RNA, 1758 nt, Artificial Sequence; identical to SEQ ID NO: 87653
  derived and/or modified sequence opt1 from hemagglutinin__InfluenzaB__AGX20228

SEQ ID NO: 88394 - RNA, 1758 nt, Artificial Sequence
  derived and/or modified sequence opt1 from hemagglutinin__InfluenzaB__AGX20239
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaucgucuggggcuuccacuccgacaacgagacccagauggccaagcucuacggggacagcaagccccagaaguucaccuccagcgccaacggcgugacgacccacuacgugucccagaucggcggguucccgaaccagaccgaggacggcgggcugccccagagcggccggaucgucguggacuacauggugcagaaguccgggaagaccggcacgaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacacgaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccaccuucgacagccucaacaucacggccgccucccugaacgacgacggccuggacaaccacaccauccuccuguacuacagcaccgccgccuccagccuggcggugacccugaugaucgccaucuucguggucuacauggugucccgcgacaacgugagcugcuccaucugccucuga

SEQ ID NO: 88395 - RNA, 1758 nt, Artificial Sequence; identical to SEQ ID NO: 87616
  derived and/or modified sequence opt1 from hemagglutinin__InfluenzaB__AGX20250

SEQ ID NO: 88396 - RNA, 1758 nt, Artificial Sequence; identical to SEQ ID NO: 87616
  derived and/or modified sequence opt1 from hemagglutinin__InfluenzaB__AGX20261

SEQ ID NO: 88397 - RNA, 1758 nt, Artificial Sequence; identical to SEQ ID NO: 87616
  derived and/or modified sequence opt1 from hemagglutinin__InfluenzaB__AGX20272

SEQ ID NO: 88398 - RNA, 1758 nt, Artificial Sequence; identical to SEQ ID NO: 87616
  derived and/or modified sequence opt1 from hemagglutinin__InfluenzaB__AGX20283

SEQ ID NO: 88399 - RNA, 1758 nt, Artificial Sequence; identical to SEQ ID NO: 87616
  derived and/or modified sequence opt1 from hemagglutinin__InfluenzaB__AGX20294

SEQ ID NO: 88400 - RNA, 1758 nt, Artificial Sequence
  derived and/or modified sequence opt1 from hemagglutinin__InfluenzaB__AGX20305
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaaccagcugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagcccuacuacaccggcgagcacgcgaaggccaucggcaacugcccgaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88401 - RNA, 1758 nt, Artificial Sequence; identical to SEQ ID NO: 87616
  derived and/or modified sequence opt1 from hemagglutinin__InfluenzaB__AGX20316

SEQ ID NO: 88402 - RNA, 1758 nt, Artificial Sequence; identical to SEQ ID NO: 87616
  derived and/or modified sequence opt1 from hemagglutinin__InfluenzaB__AGX20327

SEQ ID NO: 88403 - RNA, 1758 nt, Artificial Sequence
  derived and/or modified sequence opt1 from hemagglutinin__InfluenzaB__AGX20338
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaaccucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88404 - RNA, 1758 nt, Artificial Sequence; identical to SEQ ID NO: 87616
  derived and/or modified sequence opt1 from hemagglutinin__InfluenzaB__AGX20349

SEQ ID NO: 88405 - RNA, 1758 nt, Artificial Sequence; identical to SEQ ID NO: 87616
  derived and/or modified sequence opt1 from hemagglutinin__InfluenzaB__AGX20360

SEQ ID NO: 88406 - RNA, 1758 nt, Artificial Sequence; identical to SEQ ID NO: 87653
  derived and/or modified sequence opt1 from hemagglutinin__InfluenzaB__AGX20371

SEQ ID NO: 88407 - RNA, 1758 nt, Artificial Sequence
  derived and/or modified sequence opt1 from hemagglutinin__InfluenzaB__AGX20382
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccaugaacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88408 - RNA, 1758 nt, Artificial Sequence; identical to SEQ ID NO: 87616
  derived and/or modified sequence opt1 from hemagglutinin__InfluenzaB__AGX20393

SEQ ID NO: 88409 - RNA, 1758 nt, Artificial Sequence; identical to SEQ ID NO: 87653
  derived and/or modified sequence opt1 from hemagglutinin__InfluenzaB__AGX20404

SEQ ID NO: 88410 - RNA, 1758 nt, Artificial Sequence; identical to SEQ ID NO: 87616
  derived and/or modified sequence opt1 from hemagglutinin__InfluenzaB__AGX20415

SEQ ID NO: 88411 - RNA, 1758 nt, Artificial Sequence; identical to SEQ ID NO: 87616
  derived and/or modified sequence opt1 from hemagglutinin__InfluenzaB__AGX20426

SEQ ID NO: 88412 - RNA, 1758 nt, Artificial Sequence; identical to SEQ ID NO: 87616
  derived and/or modified sequence opt1 from hemagglutinin__InfluenzaB__AGX20437

SEQ ID NO: 88413 - RNA, 1758 nt, Artificial Sequence; identical to SEQ ID NO: 87616
  derived and/or modified sequence opt1 from hemagglutinin__InfluenzaB__AGX20448

SEQ ID NO: 88414 - RNA, 1758 nt, Artificial Sequence; identical to SEQ ID NO: 87616
  derived and/or modified sequence opt1 from hemagglutinin__InfluenzaB__AGX20459

SEQ ID NO: 88415 - RNA, 1758 nt, Artificial Sequence; identical to SEQ ID NO: 87616
  derived and/or modified sequence opt1 from hemagglutinin__InfluenzaB__AGX20470

SEQ ID NO: 88416 - RNA, 1758 nt, Artificial Sequence; identical to SEQ ID NO: 87616
  derived and/or modified sequence opt1 from hemagglutinin__InfluenzaB__AGX20481

SEQ ID NO: 88417 - RNA, 1758 nt, Artificial Sequence; identical to SEQ ID NO: 87616
  derived and/or modified sequence opt1 from hemagglutinin__InfluenzaB__AGX20492

SEQ ID NO: 88418 - RNA, 1758 nt, Artificial Sequence; identical to SEQ ID NO: 87616
  derived and/or modified sequence opt1 from hemagglutinin__InfluenzaB__AGX20503

SEQ ID NO: 88419 - RNA, 1758 nt, Artificial Sequence; identical to SEQ ID NO: 87616
  derived and/or modified sequence opt1 from hemagglutinin__InfluenzaB__AGX20514

SEQ ID NO: 88420 - RNA, 1758 nt, Artificial Sequence
  derived and/or modified sequence opt1 from hemagglutinin__InfluenzaB__AGX20525
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucuccaaccugaaggggacggagacccggggcaagcucugccccaagugccccaacugcaccgaccuggacguggcccuggggcgcccgaagugcaccggcaagauccccagcgcccggguguccauccuccacgagguccgccccgugacgagcggcugcuuccccaucaugcacgaccggaccaagauccgccagcugccgaaccugcuccggggguacgagcacauccgccuguccacccacaacgugaucaacgccgagaacgcccccggcgggcccuacaagaucggcaccagcggguccugccccaacgucacgaacggcaacggcuucuucgcgaccauggccugggccgugccgaagaacgacaagaacaagaccgccaccaacccccugacgaucgaggugcccuacaucugcaccgagggggaggaccagaucaccgucuggggcuuccacagcgacaacgagacccagauggcgaagcucuacggggacuccaagccccagaaguucacgagcuccgccaacggcgugaccacccacuacgugagccagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccacgagaaguacggcgggcugaacaaguccaagccguacuacaccggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccagccacggggcccacggcgucgccguggccgccgaccugaaguccacccaggaggcgaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcccuggagcgcaagcugaagaagaugcucggccccuccgcggucgagaucgggaacggcugcuucgagaccaagcacaagugcaaccagaccugccuggaccggaucgccgccgggaccuucgacgccggcgaguucagccugcccacguucgacucccucaacaucaccgcggccagccugaacgacgacggccuggacaaccacaccauccuccuguacuacuccaccgccgccagcucccuggccgugacgcugaugaucgcgaucuucguggucuacauggugagccgcgacaacguguccugcagcaucugccucuga

SEQ ID NO: 88421 - RNA, 1758 nt, Artificial Sequence; identical to SEQ ID NO: 87616
  derived and/or modified sequence opt1 from hemagglutinin__InfluenzaB__AGX20536

SEQ ID NO: 88422 - RNA, 1758 nt, Artificial Sequence
  derived and/or modified sequence opt1 from hemagglutinin__InfluenzaB__AGX20547
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccaccacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggagaucaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 88423 - RNA, 1758 nt, Artificial Sequence; identical to SEQ ID NO: 87670
  derived and/or modified sequence opt1 from hemagglutinin__InfluenzaB__AGX20558

SEQ ID NO: 88424 - RNA, 1758 nt, Artificial Sequence; identical to SEQ ID NO: 87616
  derived and/or modified sequence opt1 from hemagglutinin__InfluenzaB__AGX20569

SEQ ID NO: 88425 - RNA, 1758 nt, Artificial Sequence; identical to SEQ ID NO: 87653
  derived and/or modified sequence opt1 from hemagglutinin__InfluenzaB__AGX20580

SEQ ID NO: 88426 - RNA, 1758 nt, Artificial Sequence; identical to SEQ ID NO: 87616
  derived and/or modified sequence opt1 from hemagglutinin__InfluenzaB__AGX20591

SEQ ID NO: 88427 - RNA, 1758 nt, Artificial Sequence; identical to SEQ ID NO: 87616
  derived and/or modified sequence opt1 from hemagglutinin__InfluenzaB__AGX20602

SEQ ID NO: 88428 - RNA, 1758 nt, Artificial Sequence; identical to SEQ ID NO: 87616
  derived and/or modified sequence opt1 from hemagglutinin__InfluenzaB__AGX20613

SEQ ID NO: 88429 - RNA, 1758 nt, Artificial Sequence; identical to SEQ ID NO: 87616
  derived and/or modified sequence opt1 from hemagglutinin__InfluenzaB__AGX20624

SEQ ID NO: 88430 - RNA, 1758 nt, Artificial Sequence
  derived and/or modified sequence opt1 from hemagglutinin__InfluenzaB__AGX20635
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccugauggccaagcuguacggggacagcaagccccagaaguucacguccagcgccaacggcgugaccacccacuacgugucccagaucggcggguuccccaaccagaccgaggacggcgggcucccgcagagcggccggaucgucguggacuacauggugcagaaguccgggaagacgggcaccaucaccuaccagcgcggcauccugcugccccagaaggucuggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugcccgaucugggugaagacgccccugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugccucgaccggaucgccgccgggaccuucgacgcgggcgaguucucccugcccacguucgacagccugaacaucaccgccgccucccucaacgacgacggccuggacaaccacaccauccugcuguacuacagcaccgccgccuccagccucgcggugacgcugaugaucgccaucuucguggucuacauggugucccgcgacaacgugagcugcuccaucugccuguga

SEQ ID NO: 88431 - RNA, 1758 nt, Artificial Sequence; identical to SEQ ID NO: 87616
  derived and/or modified sequence opt1 from hemagglutinin__InfluenzaB__AGX20646

SEQ ID NO: 88432 - RNA, 1758 nt, Artificial Sequence
  derived and/or modified sequence opt1 from hemagglutinin__InfluenzaB__AGX20668
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaccaagaccgcgacgaacccccugaccaucgaggugcccuacaucugcaccgagggggaggaccagaucaccgucuggggcuuccacuccgacaacgagacgcagauggccaagcucuacggggacagcaagccccagaaguucaccuccagcgccaacggcgugaccacccacuacgugucccagaucggcggguucccgaaccagacggaggacggcgggcugccccagagcggccggaucgucguggacuacauggugcagaaguccgggaagaccggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacacgggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggacguucgacgcgggcgaguucucccugcccaccuucgacagccucaacaucaccgccgccucccugaacgacgacggccuggacaaccacaccauccuccuguacuacagcacggccgccuccagccuggcggugacccugaugaucgccaucuucguggucuacauggugucccgcgacaacgugagcugcuccaucugccucuga

SEQ ID NO: 88433 - RNA, 1758 nt, Artificial Sequence; identical to SEQ ID NO: 87691
  derived and/or modified sequence opt1 from hemagglutinin__InfluenzaB__AGX20679

SEQ ID NO: 88434 - RNA, 1758 nt, Artificial Sequence; identical to SEQ ID NO: 87653
  derived and/or modified sequence opt1 from hemagglutinin__InfluenzaB__AGX20690

SEQ ID NO: 88435 - RNA, 1758 nt, Artificial Sequence; identical to SEQ ID NO: 87653
  derived and/or modified sequence opt1 from hemagglutinin__InfluenzaB__AGX20701

SEQ ID NO: 88436 - RNA, 1758 nt, Artificial Sequence; identical to SEQ ID NO: 87997
  derived and/or modified sequence opt1 from hemagglutinin__InfluenzaB__AGX20712

SEQ ID NO: 88437 - RNA, 1758 nt, Artificial Sequence; identical to SEQ ID NO: 87616
  derived and/or modified sequence opt1 from hemagglutinin__InfluenzaB__AGX20723

SEQ ID NO: 88438 - RNA, 1758 nt, Artificial Sequence
  derived and/or modified sequence opt1 from hemagglutinin__InfluenzaB__AGX20734
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcaccaacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88439 - RNA, 1758 nt, Artificial Sequence
  derived and/or modified sequence opt1 from hemagglutinin__InfluenzaB__AGX20745
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccaucuggggcuuccacuccgacaacgagacccagauggccaagcucuacggggacagcaagccccagaaguucacguccagcgccaacggcgucaccacccacuacgugucccagaucggcggguucccgaaccagaccgaggacggcgggcugccccagagcggccggaucguggucgacuacauggugcagaaguccgggaagacgggcaccaucaccuaccagcgcggcauccugcucccccagaagguguggugcgccagcgggcgguccaaggucaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcguggccgucgccgcggaccugaaguccacccaggaggccaucaacaagaucacgaagaaccugaacucccucagcgagcuggaggugaagaaccugcagcgccucuccggcgccauggacgagcugcacaacgagauccuggagcucgacgagaaggucgacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggucacgcugaugaucgccaucuucgugguguacauggucucccgcgacaacgugagcugcuccaucugccucuga

SEQ ID NO: 88440 - RNA, 1758 nt, Artificial Sequence; identical to SEQ ID NO: 87997
  derived and/or modified sequence opt1 from hemagglutinin__InfluenzaB__AGX20756

SEQ ID NO: 88441 - RNA, 1758 nt, Artificial Sequence; identical to SEQ ID NO: 87616
  derived and/or modified sequence opt1 from hemagglutinin__InfluenzaB__AGX20767

SEQ ID NO: 88442 - RNA, 1758 nt, Artificial Sequence; identical to SEQ ID NO: 87653
  derived and/or modified sequence opt1 from hemagglutinin__InfluenzaB__AGX20778

SEQ ID NO: 88443 - RNA, 1758 nt, Artificial Sequence
  derived and/or modified sequence opt1 from hemagglutinin__InfluenzaB__AGX20789
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacggggagauccuggagcucgacgagaagguggacgaccugcgggccgacaccaucagcucccagaucgagcuggccgugcuccugagcaacgagggcaucaucaacuccgaggacgagcaccuccuggcgcuggagcgcaagcugaagaagaugcucgggcccagcgccgucgagaucggcaacgggugcuucgagaccaagcacaagugcaaccagaccugccuggaccggaucgccgccggcaccuucgacgcgggcgaguucucccugcccacguucgacagccucaacaucaccgccgccucccugaacgacgacgggcuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88444 - RNA, 1758 nt, Artificial Sequence
  derived and/or modified sequence opt1 from hemagglutinin__InfluenzaB__AGX20800
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacgagcuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88445 - RNA, 1758 nt, Artificial Sequence; identical to SEQ ID NO: 87691
  derived and/or modified sequence opt1 from hemagglutinin__InfluenzaB__AGX20811

SEQ ID NO: 88446 - RNA, 1758 nt, Artificial Sequence; identical to SEQ ID NO: 87691
  derived and/or modified sequence opt1 from hemagglutinin__InfluenzaB__AGX20822

SEQ ID NO: 88447 - RNA, 1758 nt, Artificial Sequence; identical to SEQ ID NO: 87691
  derived and/or modified sequence opt1 from hemagglutinin__InfluenzaB__AGX20833

SEQ ID NO: 88448 - RNA, 1758 nt, Artificial Sequence
  derived and/or modified sequence opt1 from hemagglutinin__InfluenzaB__AGX20844
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaugggcaagaucccguccgcccgggugagcauccugcacgaggugcgccccgucaccuccggcugcuuccccaucaugcacgaccggacgaagauccgccagcugcccaaccuccugcggggguacgagcacauccgccugagcacccacaacgugaucaacgccgagaacgcgccgggcgggcccuacaagaucggcaccuccgggagcugccccaacaucaccaacggcaacggcuucuucgccacgauggccugggccgugcccaagaacgacaagaacaagaccgcgaccaacccgcucaccaucgagguccccuacaucugcacggagggggaggaccagaucaccguguggggcuuccacuccgacaacgagacccagauggccaagcuguacggggacagcaagccccagaaguucaccuccagcgccaacggcgugacgacccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucgucguguacauggugucccgcgacaacgucagcugcuccaucugccuguga

SEQ ID NO: 88449 - RNA, 1758 nt, Artificial Sequence; identical to SEQ ID NO: 87616
  derived and/or modified sequence opt1 from hemagglutinin__InfluenzaB__AGX20855

SEQ ID NO: 88450 - RNA, 1758 nt, Artificial Sequence; identical to SEQ ID NO: 87691
  derived and/or modified sequence opt1 from hemagglutinin__InfluenzaB__AGX20866

SEQ ID NO: 88451 - RNA, 1758 nt, Artificial Sequence; identical to SEQ ID NO: 87691
  derived and/or modified sequence opt1 from hemagglutinin__InfluenzaB__AGX20877

SEQ ID NO: 88452 - RNA, 1758 nt, Artificial Sequence
  derived and/or modified sequence opt1 from hemagglutinin__InfluenzaB__AGX20888
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacagcgagacccagauggccaagcucuacggggacuccaagccccagaaguucacgagcuccgccaacggcgugaccacccacuacgugagccagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccacgagaaguacggcgggcugaacaaguccaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 88453 - RNA, 1758 nt, Artificial Sequence; identical to SEQ ID NO: 87691
  derived and/or modified sequence opt1 from hemagglutinin__InfluenzaB__AGX20899

SEQ ID NO: 88454 - RNA, 1758 nt, Artificial Sequence; identical to SEQ ID NO: 87691
  derived and/or modified sequence opt1 from hemagglutinin__InfluenzaB__AGX20910

SEQ ID NO: 88455 - RNA, 1758 nt, Artificial Sequence; identical to SEQ ID NO: 87616
  derived and/or modified sequence opt1 from hemagglutinin__InfluenzaB__AGX20921

SEQ ID NO: 88456 - RNA, 1758 nt, Artificial Sequence
  derived and/or modified sequence opt1 from hemagglutinin__InfluenzaB__AGX20932
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggaccccaagccgcagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcucccugccgcugaucggggaggccgacugccuccacgagaaguacggcgggcugaacaagagcaagcccuacuacaccggcgagcacgcgaaggccaucggcaacugccccaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 88457 - RNA, 1758 nt, Artificial Sequence; identical to SEQ ID NO: 87616
  derived and/or modified sequence opt1 from hemagglutinin__InfluenzaB__AGX20943

SEQ ID NO: 88458 - RNA, 1758 nt, Artificial Sequence; identical to SEQ ID NO: 87616
  derived and/or modified sequence opt1 from hemagglutinin__InfluenzaB__AGX20954

SEQ ID NO: 88459 - RNA, 1758 nt, Artificial Sequence; identical to SEQ ID NO: 87616
  derived and/or modified sequence opt1 from hemagglutinin__InfluenzaB__AGX20965

SEQ ID NO: 88460 - RNA, 1758 nt, Artificial Sequence
  derived and/or modified sequence opt1 from hemagglutinin__InfluenzaB__AGX20976
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacggggagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccgucgagaucggcaacgggugcuucgagaccaagcacaagugcaaccagaccugccuggaccggaucgccgccggcaccuucgacgcgggcgaguucucccuccccacguucgacagccugaacaucaccgccgccucccugaacgacgacgggcucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88461 - RNA, 1758 nt, Artificial Sequence; identical to SEQ ID NO: 87616
  derived and/or modified sequence opt1 from hemagglutinin__InfluenzaB__AGX20987

SEQ ID NO: 88462 - RNA, 1758 nt, Artificial Sequence; identical to SEQ ID NO: 87691
  derived and/or modified sequence opt1 from hemagglutinin__InfluenzaB__AGX20998

SEQ ID NO: 88463 - RNA, 1758 nt, Artificial Sequence
  derived and/or modified sequence opt1 from hemagglutinin__InfluenzaB__AGX21009
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacaugaucucccgcgacaacgugagcugcuccaucugccucuga

SEQ ID NO: 88464 - RNA, 1758 nt, Artificial Sequence
  derived and/or modified sequence opt1 from hemagglutinin__InfluenzaB__AGX21020
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcgagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88465 - RNA, 1758 nt, Artificial Sequence; identical to SEQ ID NO: 87691
  derived and/or modified sequence opt1 from hemagglutinin__InfluenzaB__AGX21031

SEQ ID NO: 88466 - RNA, 1758 nt, Artificial Sequence
  derived and/or modified sequence opt1 from hemagglutinin__InfluenzaB__AGX21042
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacaccgagaacgccccgggcgggcccuacaagaucggcacguccgggagcugccccaacgucaccaacggcaacggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 88467 - RNA, 1758 nt, Artificial Sequence; identical to SEQ ID NO: 87653
  derived and/or modified sequence opt1 from hemagglutinin__InfluenzaB__AGX21053

SEQ ID NO: 88468 - RNA, 1758 nt, Artificial Sequence; identical to SEQ ID NO: 87616
  derived and/or modified sequence opt1 from hemagglutinin__InfluenzaB__AGX21064

SEQ ID NO: 88469 - RNA, 1758 nt, Artificial Sequence; identical to SEQ ID NO: 87653
  derived and/or modified sequence opt1 from hemagglutinin__InfluenzaB__AGX21075

SEQ ID NO: 88470 - RNA, 1758 nt, Artificial Sequence; identical to SEQ ID NO: 87653
  derived and/or modified sequence opt1 from hemagglutinin__InfluenzaB__AGX21084

SEQ ID NO: 88471 - RNA, 1758 nt, Artificial Sequence; identical to SEQ ID NO: 87653
  derived and/or modified sequence opt1 from hemagglutinin__InfluenzaB__AGX21095

SEQ ID NO: 88472 - RNA, 1758 nt, Artificial Sequence
  derived and/or modified sequence opt1 from hemagglutinin__InfluenzaB__AGX21106
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgaggcccagauggccaagcucuacggggacagcaagccccagaaguucaccuccagcgccaacggcgugacgacccacuacgugucccagaucggcggguucccgaaccagaccgaggacggcgggcugccccagagcggccggaucgucguggacuacauggugcagaaguccgggaagaccggcacgaucaccuaccagcgcggcauccugcucccccagaaggucuggugcgccagcgggcgguccaaggugaucaagggcagccugccccugaucggggaggcggacugccuccacgagaaguacggcgggcugaacaagagcaagccguacuacaccggcgagcacgccaaggccaucggcaacugccccaucugggugaagacgccccugaagcucgccaacgggaccaaguaccggcccccggccaagcugcugaaggagcgcggcuucuucggggcgaucgccggcuuccucgagggcgggugggagggcaugaucgccggguggcacggcuacaccucccacggggcccacggcgucgccguggcggccgaccugaaguccacccaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacacgaucagcucccagaucgagcuggcggugcuccugagcaacgaggggaucaucaacuccgaggacgagcaccuccuggcccuggagcgcaagcugaagaagaugcucggccccagcgccgucgagaucgggaacggcugcuucgagaccaagcacaagugcaaccagaccugccuggaccggaucgccgcggggaccuucgacgccggcgaguucucccugcccaccuucgacagccucaacaucacggccgccucccugaacgacgacggccuggacaaccacaccauccuccuguacuacagcaccgccgcguccagccuggccgugacccugaugaucgccaucuucguggucuacauggugucccgcgacaacgugagcugcuccaucugccucuga

SEQ ID NO: 88473 - RNA, 1758 nt, Artificial Sequence; identical to SEQ ID NO: 87616
  derived and/or modified sequence opt1 from hemagglutinin__InfluenzaB__AGX21117

SEQ ID NO: 88474 - RNA, 1758 nt, Artificial Sequence; identical to SEQ ID NO: 88466
  derived and/or modified sequence opt1 from hemagglutinin__InfluenzaB__AGX21128

SEQ ID NO: 88475 - RNA, 1758 nt, Artificial Sequence
  derived and/or modified sequence opt1 from hemagglutinin__InfluenzaB__AGX21139
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcgacuucccgaaccagaccgaggacgggggccugccccagagcgggcggaucgucguggacuacauggugcagaaguccggcaagacggggaccaucaccuaccagcgcggcauccugcucccccagaaggucuggugcgccagcggccgguccaaggugaucaaggggagccugccccugaucggcgaggccgacugccuccacgagaaguacgggggccugaacaagagcaagccguacuacaccggggagcacgcgaaggccaucggcaacugccccaucugggugaagacgccccugaagcucgccaacggcaccaaguaccggcccccggccaagcugcugaaggagcgcggguucuucggcgccaucgcgggguuccucgagggcgggugggagggcaugaucgccggcuggcacggguacaccucccacggcgcccacggggucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgagggcaucaucaacuccgaggacgagcaccuccuggcgcuggagcgcaagcugaagaagaugcucgggcccagcgccgucgagaucggcaacgggugcuucgagaccaagcacaagugcaaccagaccugccuggaccggaucgccgccggcaccuucgacgcgggggaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88476 - RNA, 1758 nt, Artificial Sequence; identical to SEQ ID NO: 87691
  derived and/or modified sequence opt1 from hemagglutinin__InfluenzaB__AGX21150

SEQ ID NO: 88477 - RNA, 1758 nt, Artificial Sequence; identical to SEQ ID NO: 87616
  derived and/or modified sequence opt1 from hemagglutinin__InfluenzaB__AGX21161

SEQ ID NO: 88478 - RNA, 1758 nt, Artificial Sequence; identical to SEQ ID NO: 87691
  derived and/or modified sequence opt1 from hemagglutinin__InfluenzaB__AGX21172

SEQ ID NO: 88479 - RNA, 1758 nt, Artificial Sequence; identical to SEQ ID NO: 87653
  derived and/or modified sequence opt1 from hemagglutinin__InfluenzaB__AGX21183

SEQ ID NO: 88480 - RNA, 1758 nt, Artificial Sequence; identical to SEQ ID NO: 87691
  derived and/or modified sequence opt1 from hemagglutinin__InfluenzaB__AGX21194

SEQ ID NO: 88481 - RNA, 1758 nt, Artificial Sequence
  derived and/or modified sequence opt1 from hemagglutinin__InfluenzaB__AGX21205
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccaagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 88482 - RNA, 1758 nt, Artificial Sequence; identical to SEQ ID NO: 87653
  derived and/or modified sequence opt1 from hemagglutinin__InfluenzaB__AGX21216

SEQ ID NO: 88483 - RNA, 1758 nt, Artificial Sequence; identical to SEQ ID NO: 87616
  derived and/or modified sequence opt1 from hemagglutinin__InfluenzaB__AGX21227

SEQ ID NO: 88484 - RNA, 1758 nt, Artificial Sequence
  derived and/or modified sequence opt1 from hemagglutinin__InfluenzaB__AGX21238
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccaacgggcggagcaaggugaucaagggcucccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacaugaucagccgcgacaacguguccugcagcaucugccuguga

SEQ ID NO: 88485 - RNA, 1758 nt, Artificial Sequence; identical to SEQ ID NO: 87691
  derived and/or modified sequence opt1 from hemagglutinin__InfluenzaB__AGX21249

SEQ ID NO: 88486 - RNA, 1758 nt, Artificial Sequence
  derived and/or modified sequence opt1 from hemagglutinin__InfluenzaB__AGX21260
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagcgggucuggugcgccagcgggcgcuccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 88487 - RNA, 1758 nt, Artificial Sequence; identical to SEQ ID NO: 87616
  derived and/or modified sequence opt1 from hemagglutinin__InfluenzaB__AGX21271

SEQ ID NO: 88488 - RNA, 1758 nt, Artificial Sequence
  derived and/or modified sequence opt1 from hemagglutinin__InfluenzaB__AGX21282
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccagccccaccaagucccacuucgccaaccugaaggggaccgagacgcggggcaagcucugccccaagugccugaacugcaccgaccuggacgucgcccucgggcgccccaagugcaccggcaagaucccgagcgcccggguguccauccugcacgaggugcgccccgucaccagcggcugcuuccccaucaugcacgaccggacgaagauccgccagcugcccaaccuccugcggggguacgagcacauccgccuguccacccacaacgugaucaacgccaagaacgcgccgggcgggcccuacaagaucggcaccagcggguccugccccaacaucaccaacggcaacggcuucuucgccacgauggccugggccgugcccaagaacgacaagaacaagaccgcgaccaacccgcucaccaucgagguccccuacaucugcacggagggggaggaccagaucaccguguggggcuuccacagcgacaacgagacccagauggccaagcuguacggggacuccaagccccagaaguucaccagcuccgccaacggcgugacgacccacuacgucagccagaucggcggguuccccaaccagaccgaggacggcgggcugccgcaguccggccggaucgugguggacuacaugguccagaaguccgggaagaccggcacgaucaccuaccagcgcggcauccuccugccccagaagguguggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccguggccgcggaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccaccuucgacucccugaacaucacggccgccagccugaacgacgacggccucgacaaccacaccauccugcuguacuacuccaccgccgccagcucccuggcggugacccucaugaucgccaucuucgucguguacauggugagccgcgacaacgucuccugcagcaucugccuguga

SEQ ID NO: 88489 - RNA, 1758 nt, Artificial Sequence; identical to SEQ ID NO: 87653
  derived and/or modified sequence opt1 from hemagglutinin__InfluenzaB__AGX21293

SEQ ID NO: 88490 - RNA, 1758 nt, Artificial Sequence; identical to SEQ ID NO: 87691
  derived and/or modified sequence opt1 from hemagglutinin__InfluenzaB__AGX21304

SEQ ID NO: 88491 - RNA, 1758 nt, Artificial Sequence; identical to SEQ ID NO: 87653
  derived and/or modified sequence opt1 from hemagglutinin__InfluenzaB__AGX21315

SEQ ID NO: 88492 - RNA, 1758 nt, Artificial Sequence; identical to SEQ ID NO: 87616
  derived and/or modified sequence opt1 from hemagglutinin__InfluenzaB__AGX21326

SEQ ID NO: 88493 - RNA, 1758 nt, Artificial Sequence
  derived and/or modified sequence opt1 from hemagglutinin__InfluenzaB__AGX21337
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaaggagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88494 - RNA, 1758 nt, Artificial Sequence; identical to SEQ ID NO: 87653
  derived and/or modified sequence opt1 from hemagglutinin__InfluenzaB__AGX21348

SEQ ID NO: 88495 - RNA, 1758 nt, Artificial Sequence; identical to SEQ ID NO: 87653
  derived and/or modified sequence opt1 from hemagglutinin__InfluenzaB__AGX21359

SEQ ID NO: 88496 - RNA, 1758 nt, Artificial Sequence
  derived and/or modified sequence opt1 from hemagglutinin__InfluenzaB__AGX21370
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaugggcaagauccccuccgcccgggugagcauccuccacgagguccgccccgugaccuccggcugcuuccccaucaugcacgaccggacgaagauccgccagcugccgaaccugcuccggggguacgagcacauccgccugagcacccacaacgugaucaacgccgagaacgcgcccggcgggcccuacaagaucggcaccuccgggagcugccccaacgucaccaacggcaacggcuucuucgccacgauggccugggccgugccgaagaacgacaagaacaagaccgcgaccaacccccugaccaucgaggugcccuacaucugcacggagggggaggaccagaucaccgucuggggcuuccacuccgacaacgagacccagauggccaagcucuacggggacagcaagccccagaaguucaccuccagcgccaacggcgugacgacccacuacgugucccagaucggcggguucccgaaccagaccgaggacggcgggcugccccagagcggccggaucgucguggacuacauggugcagaaguccgggaagaccggcacgaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacacgaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccaccuucgacagccucaacaucacggccgccucccugaacgacgacggccuggacaaccacaccauccuccuguacuacagcaccgccgccuccagccuggcggugacccugaugaucgccaucuucguggucuacauggugucccgcgacaacgugagcugcuccaucugccucuga

SEQ ID NO: 88497 - RNA, 1758 nt, Artificial Sequence
  derived and/or modified sequence opt1 from hemagglutinin__InfluenzaB__AGX21381
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacaucucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88498 - RNA, 1758 nt, Artificial Sequence
  derived and/or modified sequence opt1 from hemagglutinin__InfluenzaB__AGX21392
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgaggcccagauggccaagcuguacggggacagcaagccccagaaguucaccuccagcgccaacggcgugacgacccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccagcgggcgguccaaggugaucaagggcagccugccccucaucggggaggcggacugccugcacgagaaguacggcgggcugaacaagagcaagcccuacuacaccggcgagcacgccaaggccaucggcaacugcccgaucugggucaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccguggcggccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgcgguccugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucgucguguacauggugucccgcgacaacgucagcugcuccaucugccuguga

SEQ ID NO: 88499 - RNA, 1758 nt, Artificial Sequence
  derived and/or modified sequence opt1 from hemagglutinin__InfluenzaB__AGX21403
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccugaaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 88500 - RNA, 1758 nt, Artificial Sequence
  derived and/or modified sequence opt1 from hemagglutinin__InfluenzaB__AGX21414
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccgacccccugacgaucgaggugcccuacaucugcaccgagggggaggaccagaucaccgucuggggcuuccacuccgacaacgagacccagauggccaagcucuacggggacagcaagccccagaaguucacguccagcuccaacggcgugaccacccacuacgugagccagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccacgagaaguacggcgggcugaacaaguccaagccguacuacaccggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccagccacggggcccacggcgucgccguggccgccgaccugaaguccacccaggaggcgaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcccuggagcgcaagcugaagaagaugcucggccccuccgcggucgagaucgggaacggcugcuucgagaccaagcacaagugcaaccagaccugccuggaccggaucgccgccgggaccuucgacgccggcgaguucagccugcccacguucgacucccucaacaucaccgcggccagccugaacgacgacggccuggacaaccacaccauccuccuguacuacuccaccgccgccagcucccuggccgugacgcugaugaucgcgaucuucguggucuacauggugagccgcgacaacguguccugcagcaucugccucuga

SEQ ID NO: 88501 - RNA, 1758 nt, Artificial Sequence; identical to SEQ ID NO: 87616
  derived and/or modified sequence opt1 from hemagglutinin__InfluenzaB__AGX21425

SEQ ID NO: 88502 - RNA, 1758 nt, Artificial Sequence
  derived and/or modified sequence opt1 from hemagglutinin__InfluenzaB__AGX21436
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccguggccuccagccuggccgucacgcucaugaucgcgaucuucgugguguacauggucucccgcgacaacgugagcugcuccaucugccuguga

SEQ ID NO: 88503 - RNA, 1758 nt, Artificial Sequence; identical to SEQ ID NO: 87691
  derived and/or modified sequence opt1 from hemagglutinin__InfluenzaB__AGX21447

SEQ ID NO: 88504 - RNA, 1758 nt, Artificial Sequence; identical to SEQ ID NO: 87616
  derived and/or modified sequence opt1 from hemagglutinin__InfluenzaB__AGX21458

SEQ ID NO: 88505 - RNA, 1758 nt, Artificial Sequence; identical to SEQ ID NO: 87616
  derived and/or modified sequence opt1 from hemagglutinin__InfluenzaB__AGX21469

SEQ ID NO: 88506 - RNA, 1758 nt, Artificial Sequence
  derived and/or modified sequence opt1 from hemagglutinin__InfluenzaB__AGX21480
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgaggacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88507 - RNA, 1758 nt, Artificial Sequence; identical to SEQ ID NO: 87691
  derived and/or modified sequence opt1 from hemagglutinin__InfluenzaB__AGX21491

SEQ ID NO: 88508 - RNA, 1758 nt, Artificial Sequence; identical to SEQ ID NO: 87691
  derived and/or modified sequence opt1 from hemagglutinin__InfluenzaB__AGX21502

SEQ ID NO: 88509 - RNA, 1758 nt, Artificial Sequence; identical to SEQ ID NO: 87616
  derived and/or modified sequence opt1 from hemagglutinin__InfluenzaB__AGX21513

SEQ ID NO: 88510 - RNA, 1758 nt, Artificial Sequence; identical to SEQ ID NO: 87653
  derived and/or modified sequence opt1 from hemagglutinin__InfluenzaB__AGX21524

SEQ ID NO: 88511 - RNA, 1758 nt, Artificial Sequence
  derived and/or modified sequence opt1 from hemagglutinin__InfluenzaB__AGX21535
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacagcgagacccagauggccaagcuguacggggacuccaagccccagaaguucacgagcuccgccaacggcgugaccacccacuacgucagccagaucggcggguuccccaaccagaccgaggacggcgggcugccgcaguccggccggaucgugguggacuacaugguccagaaguccgggaagacgggcaccaucaccuaccagcgcggcauccuccugccccagaagguguggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccguccugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucgucguguacauggugagccgcgacaacgucuccugcagcaucugccuguga

SEQ ID NO: 88512 - RNA, 1758 nt, Artificial Sequence; identical to SEQ ID NO: 87653
  derived and/or modified sequence opt1 from hemagglutinin__InfluenzaB__AGX21546

SEQ ID NO: 88513 - RNA, 1758 nt, Artificial Sequence
  derived and/or modified sequence opt1 from hemagglutinin__InfluenzaB__AGX21557
augaaggccaucaucgugcugcucauggucgugaccagcaacgccgaccgcaucugcaccggcaucacguccagcaacagcccccacguggucaagaccgcgacccagggggaggugaacgugaccggcgucaucacgcugaccaccaccccgacgaagucccacuucgccaaccugaaggggaccgagacccggggcaagcucugccccaagugccugaacugcaccgaccuggacguggcccucgggcgccccaagugcacgggcaagauccccuccgcccgggugagcauccugcacgagguccgcccggugaccuccggcugcuuccccaucaugcacgaccggaccaagauccgccagcugcccaaccuccugcggggguacgagcacauccgccugagcacccacaacgugaucaacgccgagaacgcgcccggcgggccguacaagaucggcacguccgggagcugccccaacgucaccaacggcaacggcuucuucgccaccauggccugggccgugcccaagaacgacaagaacaagaccgcgacgaacccccucaccaucgaggugccguacaucugcaccgagggggaggaccagaucaccgucuggggcuuccacuccgacaacgagacgcagauggccaagcuguacggggacagcaagccccagaaguucaccuccagcgccaacggcgugaccacccacuacgugucccagaucggcggguuccccaaccagacggaggacggcgggcugccccagagcggccggaucgucguggacuacauggugcagaaguccgggaagaccggcaccaucaccuaccagcgcggcauccuccugccgcagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccucaagagcacgcaggaggccaucaacaagaucaccaagaaccugaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcuccaucugccuguga

SEQ ID NO: 88514 - RNA, 1758 nt, Artificial Sequence
  derived and/or modified sequence opt1 from hemagglutinin__InfluenzaB__AGX21568
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaugaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88515 - RNA, 1758 nt, Artificial Sequence; identical to SEQ ID NO: 87616
  derived and/or modified sequence opt1 from hemagglutinin__InfluenzaB__AGX21579

SEQ ID NO: 88516 - RNA, 1758 nt, Artificial Sequence; identical to SEQ ID NO: 87653
  derived and/or modified sequence opt1 from hemagglutinin__InfluenzaB__AGX21590

SEQ ID NO: 88517 - RNA, 1758 nt, Artificial Sequence; identical to SEQ ID NO: 88466
  derived and/or modified sequence opt1 from hemagglutinin__InfluenzaB__AGX21601

SEQ ID NO: 88518 - RNA, 1758 nt, Artificial Sequence; identical to SEQ ID NO: 87653
  derived and/or modified sequence opt1 from hemagglutinin__InfluenzaB__AGX21611

SEQ ID NO: 88519 - RNA, 1758 nt, Artificial Sequence; identical to SEQ ID NO: 87997
  derived and/or modified sequence opt1 from hemagglutinin__InfluenzaB__AGX21622

SEQ ID NO: 88520 - RNA, 1758 nt, Artificial Sequence
  derived and/or modified sequence opt1 from hemagglutinin__InfluenzaB__AGX21633
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgcccggcugcucaaggagcgcggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccguccugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgggacaacgucagcugcuccaucugccuguga

SEQ ID NO: 88521 - RNA, 1758 nt, Artificial Sequence; identical to SEQ ID NO: 87691
  derived and/or modified sequence opt1 from hemagglutinin__InfluenzaB__AGX21644

SEQ ID NO: 88522 - RNA, 1758 nt, Artificial Sequence; identical to SEQ ID NO: 87616
  derived and/or modified sequence opt1 from hemagglutinin__InfluenzaB__AGX21655

SEQ ID NO: 88523 - RNA, 1758 nt, Artificial Sequence
  derived and/or modified sequence opt1 from hemagglutinin__InfluenzaB__AGX21666
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggacaagaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgggacaacgugagcugcuccaucugccucuga

SEQ ID NO: 88524 - RNA, 1758 nt, Artificial Sequence; identical to SEQ ID NO: 87691
  derived and/or modified sequence opt1 from hemagglutinin__InfluenzaB__AGX21677

SEQ ID NO: 88525 - RNA, 1758 nt, Artificial Sequence; identical to SEQ ID NO: 87616
  derived and/or modified sequence opt1 from hemagglutinin__InfluenzaB__AGX21688

SEQ ID NO: 88526 - RNA, 1758 nt, Artificial Sequence
  derived and/or modified sequence opt1 from hemagglutinin__InfluenzaB__AGX21699
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaaccuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugagcgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88527 - RNA, 1758 nt, Artificial Sequence; identical to SEQ ID NO: 88466
  derived and/or modified sequence opt1 from hemagglutinin__InfluenzaB__AGX21710

SEQ ID NO: 88528 - RNA, 1758 nt, Artificial Sequence; identical to SEQ ID NO: 87691
  derived and/or modified sequence opt1 from hemagglutinin__InfluenzaB__AGX21721

SEQ ID NO: 88529 - RNA, 1755 nt, Artificial Sequence
  derived and/or modified sequence opt1 from hemagglutinin__InfluenzaB__AGX21732
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggggccccaugugcgugggcaucacgccguccgccaaggcgagcauccugcacgaggugcgccccgucaccuccgggugcuuccccaucaugcacgaccggaccaagauccgccagcugcccaaccuccugcggggcuacgagaagauccgccugagcgcccagaacgugaucaacgccgagaaggcccccgggggccccuacaagcucgggaccuccggcagcugccccaacgcgacguccaagagcggcuucuucgccaccauggccugggccgugccccgggacgacaacaagaccgccaccaacccgcugacggucgaggugccccacaucugcgcgaacgaggaggaccagaucaccguguggggguuccacuccgacaacaagacccagaugaagaaccuguacggcgacagcaacccccagaaguucaccuccagcgccaacgggaucacgacccacuacgucucccagaucggcggcuuccccgaccagaccgaggacgggggccucccgcagagcgggcgcaucgugguggacuacaugguccagaagcccggcaagaccgggacgaucguguaccagcggggcauccugcugccccagaagguguggugcgccuccggccgcagcaaggucaucaaggggagccucccccugaucggcgaggccgacugccugcacgagaaguacgggggccucaacaaguccaagccguacuacaccggggagcacgccaaggcgaucggcaacugccccaucugggugaagacgccccugaagcuggccaacggcaccaaguaccggcccccggccaagcuccugaaggagcgcggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggccgugcugcucuccaacgagggcaucaucaacagcgaggacgagcaccuccuggcgcuggagcggaagcugaagaagaugcuggggcccuccgccguggacaucggcaacgggugcuucgagacgaagcacaagugcaaccagaccugccucgaccgcaucgccgccggcaccuucaacgccggggaguucagccugcccaccuucgacucccugaacaucaccgcggccagccucaacgacgacggccuggacaaccacacgauccugcuguacuacuccaccgccgccagcucccucgccgucacccugaugaucgcgaucuucaucguguacaugaucagccgggacaacguguccugcagcaucugccuguga

SEQ ID NO: 88530 - RNA, 1755 nt, Artificial Sequence
  derived and/or modified sequence opt1 from hemagglutinin__InfluenzaB__AGX21743
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggcccucggcgggccguaccggcugggcacguccgggagcugccccaacgccaccuccaagagcggcuucuucgccaccauggcgugggccguccccaaggacaacaacaagaacgccaccaacccccugacgguggaggugccguacaucugcaccgagggcgaggaccagaucaccgucuggggguuccacuccgacaacaagacccagaugaagaaccucuacggcgacagcaacccccagaaguucacguccagcgccaacggggugaccacccacuacgugucccagaucggcggcuuccccgaccagaccgaggacgggggccugccccagagcgggcgcaucgucguggacuacauggugcagaagccgggcaagacggggaccaucgucuaccagcggggcgugcugcucccccagaagguguggugcgccuccggcaagagcaaggucaucaaggggagccugccccugaucggcgaggcggacugccuccacgagaaguacgggggccugaacaaguccaagcccuacuacaccggggagcacgccaaggccaucggcaacugcccgaucugggugaagacgccccugaagcucgccaacggcaccaaguaccgcccgcccgccaagcugcugaaggagcggggguucuucggcgcgaucgccggguuccucgagggcgggugggagggcaugaucgccggcuggcacggguacaccagccacggcgcccacggggucgccguggcggccgaccugaaguccacccaggaggccaucaacaagaucaccaagaaccugaacagccucuccgagcuggaggugaagaaccugcagcgccucagcggcgccauggacgagcugcacaacgagauccuggagcucgacgagaaggucgacgaccugcgggccgacacgaucuccagccagaucgagcuggcggugcuccuguccaacgagggcaucaucaacagcgaggacgagcaccuccuggcccuggagcgcaagcugaagaagaugcucgggcccuccgccguggacaucggcaacgggugcuucgagaccaagcacaagugcaaccagaccugccuggaccggaucgccgcgggcaccuucaacgccggggaguucagccugcccaccuucgacucccucaacaucacggccgccagccugaacgacgacggccuggacaaccacaccauccugcucuacuacuccaccgccgcgagcucccuggccgucacccugaugcucgccaucuucaucguguacauggugagccgcgacaacgucuccugcagcaucugccuguga

SEQ ID NO: 88531 - RNA, 1755 nt, Artificial Sequence
  derived and/or modified sequence opt1 from hemagglutinin__InfluenzaB__AGX21754
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccgccaagucccacuucgccaaccugaaggggaccaagacgcggggcaagcucugcccgaccugccugaacugcaccgaccuggacgucgcccucgggggccccaugugcgugggcaucaccccguccgcgaaggccagcauccugcacgaggugcgccccgucacguccgggugcuuccccaucaugcacgaccggaccaagauccgccagcugcccaaccuccugcggggcuacgagaagauccgccugagcgcccagaacgugaucaacgccgagaaggcgcccgggggccccuacaagcucgggaccuccggcagcugccccaacgccaccuccaagagcggcuucuucgccacgauggccugggccgugccccgggacgacaacaagaccgcgaccaacccgcugaccgucgaggugccccacaucugcgccaacgaggaggaccagaucacgguguggggguuccacuccgacaacaagacccagaugaagaaccuguacggcgacagcaacccccagaaguucaccuccagcgccaacgggaucaccacgcacuacgucucccagaucggcggcuuccccgaccagaccgaggacgggggccucccgcagagcgggcgcaucgugguggacuacaugguccagaagcccggcaagaccgggaccaucguguaccagcggggcauccugcugccccagaagguguggugcgccuccggccgcagcaaggucaucaaggggagccucccccugaucggcgaggccgacugccugcacgagaaguacgggggccucaacaaguccaagccguacuacacgggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagacgugccucgaccgcaucgccgccggcaccuucaacgcgggggaguucagccugcccaccuucgacucccugaacaucaccgccgccagccucaacgacgacggccuggacaaccacaccauccugcuguacuacuccacggccgccagcucccucgcggucacccugaugaucgccaucuucaucguguacaugaucagccgggacaacguguccugcagcaucugccuguga

SEQ ID NO: 88532 - RNA, 1755 nt, Artificial Sequence
  derived and/or modified sequence opt1 from hemagglutinin__InfluenzaB__AGX21776
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaucaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggccccgggcgggcccuaccggcucggcaccuccgggagcugccccaacgccacguccaagagcggcuucuucgccaccauggcgugggccguccccaaggacaacaacaagaacgccaccaacccgcugaccguggaggugcccuacgucugcacggagggcgaggaccagaucaccguguggggguuccacuccgacaacaagacccagaugaagaaccuguacggcgacagcaacccccagaaguucaccuccagcgccaacggggugacgacccacuacgucucccagaucggcggcuuccccgaccagaccgaggacgggggccucccgcagagcgggcgcaucgugguggacuacaugguccagaagcccggcaagaccgggacgaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacaccaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagacgaagcacaagugcaaccagaccugccucgaccgcaucgccgcgggcaccuucaacgccggggaguucagccugcccaccuucgacucccugaacaucaccgccgccagccucaacgacgacggccuggacaaccacacgauccugcuguacuacuccaccgccgcgagcucccucgccgugacccugaugcuggccaucuucaucguguacauggucagccgggacaacguguccugcagcaucugccucuga

SEQ ID NO: 88533 - RNA, 1758 nt, Artificial Sequence; identical to SEQ ID NO: 87987
  derived and/or modified sequence opt1 from hemagglutinin__InfluenzaB__AGX21787

SEQ ID NO: 88534 - RNA, 1755 nt, Artificial Sequence
  derived and/or modified sequence opt1 from hemagglutinin__InfluenzaB__AGX21798
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgaccagaccgaggacgggggccucccgcagagcgggcgcaucgugguggacuacaugguccagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgggacaacguguccugcagcaucugccucuga

SEQ ID NO: 88535 - RNA, 1755 nt, Artificial Sequence
  derived and/or modified sequence opt1 from hemagglutinin__InfluenzaB__AGX21809
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgaccagaccgaggacgggggccucccgcagagcgggcgcaucgugguggacuacaugguccagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaagucccggccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacacgaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgcgacaacguguccugcagcaucugccucuga

SEQ ID NO: 88536 - RNA, 1755 nt, Artificial Sequence
  derived and/or modified sequence opt1 from hemagglutinin__InfluenzaB__AGX21820
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccaacaaguccggcuucuucgccaccauggcgugggccguccccaaggacaacaacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccgcaguccgggcgcaucgucguggacuacaugaugcagaagcccggcaagacggggaccaucguguaccagcggggcguccugcugccccagaagguguggugcgccagcggccgcuccaaggugaucaaggggagccucccccugaucggcgaggcggacugccugcacgagaaguacgggggccucaacaagagcaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 88537 - RNA, 1755 nt, Artificial Sequence; identical to SEQ ID NO: 88031
  derived and/or modified sequence opt1 from hemagglutinin__InfluenzaB__AGX21831

SEQ ID NO: 88538 - RNA, 1755 nt, Artificial Sequence; identical to SEQ ID NO: 88034
  derived and/or modified sequence opt1 from hemagglutinin__InfluenzaB__AGX21842

SEQ ID NO: 88539 - RNA, 1755 nt, Artificial Sequence; identical to SEQ ID NO: 88034
  derived and/or modified sequence opt1 from hemagglutinin__InfluenzaB__AGX21853

SEQ ID NO: 88540 - RNA, 1755 nt, Artificial Sequence
  derived and/or modified sequence opt1 from hemagglutinin__InfluenzaB__AGX21864
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcaaccagaacgugaucgacgcggagaaggccccgggcgggcccuaccggcucggcaccuccgggagcugccccaacgccacguccaagagcggcuucuucgccaccauggcgugggccguccccaaggacaacaacaagaacgccaccaacccgcugaccguggaggugcccuacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccgcagagcgggcgcaucgucguggacuacaugaugcagaagcccggcaagaccgggacgaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgccgcgggcaccuucaacgccggggaguucagccugcccaccuucgacucccugaacaucaccgccgccagccucaacgacgacggccuggacaaccacacgauccugcuguacuacuccaccgccgcgagcucccucgccgugacccugaugcuggccaucuucaucgucuacauggugagccgggacaacguguccugcagcaucugccucuga

SEQ ID NO: 88541 - RNA, 1755 nt, Artificial Sequence; identical to SEQ ID NO: 88032
  derived and/or modified sequence opt1 from hemagglutinin__InfluenzaB__AGX21875

SEQ ID NO: 88542 - RNA, 1755 nt, Artificial Sequence; identical to SEQ ID NO: 88031
  derived and/or modified sequence opt1 from hemagglutinin__InfluenzaB__AGX21886

SEQ ID NO: 88543 - RNA, 1755 nt, Artificial Sequence; identical to SEQ ID NO: 88031
  derived and/or modified sequence opt1 from hemagglutinin__InfluenzaB__AGX21897

SEQ ID NO: 88544 - RNA, 1755 nt, Artificial Sequence; identical to SEQ ID NO: 88031
  derived and/or modified sequence opt1 from hemagglutinin__InfluenzaB__AGX21908

SEQ ID NO: 88545 - RNA, 1755 nt, Artificial Sequence
  derived and/or modified sequence opt1 from hemagglutinin__InfluenzaB__AGX21919
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaaggccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagccguacuacaccggggagcacgccaaggccaucggcaacugccccaucugggucaagacgccccugaagcuggccaacggcaccaaguaccggcccccggcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88546 - RNA, 1755 nt, Artificial Sequence; identical to SEQ ID NO: 88034
  derived and/or modified sequence opt1 from hemagglutinin__InfluenzaB__AGX21941

SEQ ID NO: 88547 - RNA, 1755 nt, Artificial Sequence; identical to SEQ ID NO: 88031
  derived and/or modified sequence opt1 from hemagglutinin__InfluenzaB__AGX21952

SEQ ID NO: 88548 - RNA, 1755 nt, Artificial Sequence; identical to SEQ ID NO: 88034
  derived and/or modified sequence opt1 from hemagglutinin__InfluenzaB__AGX21963

SEQ ID NO: 88549 - RNA, 1755 nt, Artificial Sequence
  derived and/or modified sequence opt1 from hemagglutinin__InfluenzaB__AGX21974
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggugaacaacaagaacgccaccaacccgcugacgguggagguccccuacaucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcagcuuccccgaccagaccgaggacggcgggcucccgcaguccggccgcaucgugguggacuacaugaugcagaagcccgggaagacgggcaccaucgucuaccagcgcggggugcugcugccccagaagguguggugcgccagcggccggagcaaggucaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaaggucgacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgucacccugaugcuggccaucuucaucguguacaugaucucccgggacaacgugagcugcagcaucugccucuga

SEQ ID NO: 88550 - RNA, 1755 nt, Artificial Sequence; identical to SEQ ID NO: 88034
  derived and/or modified sequence opt1 from hemagglutinin__InfluenzaB__AGX21985

SEQ ID NO: 88551 - RNA, 1755 nt, Artificial Sequence; identical to SEQ ID NO: 88032
  derived and/or modified sequence opt1 from hemagglutinin__InfluenzaB__AGX21996

SEQ ID NO: 88552 - RNA, 1755 nt, Artificial Sequence; identical to SEQ ID NO: 88032
  derived and/or modified sequence opt1 from hemagglutinin__InfluenzaB__AGX22007

SEQ ID NO: 88553 - RNA, 1755 nt, Artificial Sequence; identical to SEQ ID NO: 88031
  derived and/or modified sequence opt1 from hemagglutinin__InfluenzaB__AGX22018

SEQ ID NO: 88554 - RNA, 1755 nt, Artificial Sequence; identical to SEQ ID NO: 88031
  derived and/or modified sequence opt1 from hemagglutinin__InfluenzaB__AGX22029

SEQ ID NO: 88555 - RNA, 1755 nt, Artificial Sequence; identical to SEQ ID NO: 88031
  derived and/or modified sequence opt1 from hemagglutinin__InfluenzaB__AGX22040

SEQ ID NO: 88556 - RNA, 1755 nt, Artificial Sequence
  derived and/or modified sequence opt1 from hemagglutinin__InfluenzaB__AGX22051
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaucgaggacgggggccucccgcagagcgggcgcaucgucguggacuacaugaugcagaagcccggcaagaccgggacgaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgcccuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggagaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88557 - RNA, 1755 nt, Artificial Sequence; identical to SEQ ID NO: 88031
  derived and/or modified sequence opt1 from hemagglutinin__InfluenzaB__AGX22062

SEQ ID NO: 88558 - RNA, 1755 nt, Artificial Sequence
  derived and/or modified sequence opt1 from hemagglutinin__InfluenzaB__AGX22073
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguucaucgagggcgggugggagggcaugaucgccggcuggcacggguacaccagccacggcgcccacgggguggccgucgcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgccgcgggcaccuucaacgccggggacuucagccuccccaccuucgacucccugaacaucacggccgccagccugaacgacgacggccucgacaaccacaccauccugcuguacuacuccaccgccgcgagcucccuggccgugacccucaugcuggccaucuucaucgucuacauggugagccgggacaacguguccugcagcaucugccuguga

SEQ ID NO: 88559 - RNA, 1755 nt, Artificial Sequence; identical to SEQ ID NO: 88034
  derived and/or modified sequence opt1 from hemagglutinin__InfluenzaB__AGX22095

SEQ ID NO: 88560 - RNA, 1755 nt, Artificial Sequence; identical to SEQ ID NO: 88032
  derived and/or modified sequence opt1 from hemagglutinin__InfluenzaB__AGX22106

SEQ ID NO: 88561 - RNA, 1755 nt, Artificial Sequence
  derived and/or modified sequence opt1 from hemagglutinin__InfluenzaB__AGX22128
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgcccagaccgaggacgggggccucccgcagagcgggcgcaucgugguggacuacaugguccagaagccccggaagacgggcaccaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgagaucaagaaccugcagcgccugagcggggccaugaacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugcuggccaucuucaucguguacauggugagccgcgacaacgucuccugcagcaucugccucuga

SEQ ID NO: 88562 - RNA, 1755 nt, Artificial Sequence
  derived and/or modified sequence opt1 from hemagglutinin__InfluenzaB__AGX22139
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccgaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88563 - RNA, 1755 nt, Artificial Sequence; identical to SEQ ID NO: 88562
  derived and/or modified sequence opt1 from hemagglutinin__InfluenzaB__AGX22150

SEQ ID NO: 88564 - RNA, 1755 nt, Artificial Sequence; identical to SEQ ID NO: 88562
  derived and/or modified sequence opt1 from hemagglutinin__InfluenzaB__AGX22161

SEQ ID NO: 88565 - RNA, 1755 nt, Artificial Sequence; identical to SEQ ID NO: 88031
  derived and/or modified sequence opt1 from hemagglutinin__InfluenzaB__AGX22172

SEQ ID NO: 88566 - RNA, 1755 nt, Artificial Sequence; identical to SEQ ID NO: 88562
  derived and/or modified sequence opt1 from hemagglutinin__InfluenzaB__AGX22183

SEQ ID NO: 88567 - RNA, 1755 nt, Artificial Sequence; identical to SEQ ID NO: 88562
  derived and/or modified sequence opt1 from hemagglutinin__InfluenzaB__AGX22194

SEQ ID NO: 88568 - RNA, 1755 nt, Artificial Sequence; identical to SEQ ID NO: 88562
  derived and/or modified sequence opt1 from hemagglutinin__InfluenzaB__AGX22205

SEQ ID NO: 88569 - RNA, 1755 nt, Artificial Sequence; identical to SEQ ID NO: 88032
  derived and/or modified sequence opt1 from hemagglutinin__InfluenzaB__AGX22216

SEQ ID NO: 88570 - RNA, 1755 nt, Artificial Sequence; identical to SEQ ID NO: 88034
  derived and/or modified sequence opt1 from hemagglutinin__InfluenzaB__AGX22227

SEQ ID NO: 88571 - RNA, 1755 nt, Artificial Sequence
  derived and/or modified sequence opt1 from hemagglutinin__InfluenzaB__AGX22238
augaaggccaucaucgugcugcucauggucgugaccagcaacgccgaccgcaucugcaccggcaucacguccagcaacagcccccacauggugaagaccgcgacccagggggaggucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccgugcccaaggacaacaacaagaacgccaccaacccgcugacggucgaggugcccuacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgaccagaccgaggacgggggccucccgcagagcgggcgcaucguggucgacuacaugaugcagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgggacaacguguccugcagcaucugccucuga

SEQ ID NO: 88572 - RNA, 1755 nt, Artificial Sequence; identical to SEQ ID NO: 88032
  derived and/or modified sequence opt1 from hemagglutinin__InfluenzaB__AGX22249

SEQ ID NO: 88573 - RNA, 1755 nt, Artificial Sequence; identical to SEQ ID NO: 88031
  derived and/or modified sequence opt1 from hemagglutinin__InfluenzaB__AGX22260

SEQ ID NO: 88574 - RNA, 1755 nt, Artificial Sequence
  derived and/or modified sequence opt1 from hemagglutinin__InfluenzaB__AGX22271
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccagcgccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggccgagcgccguggagaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcagcaucugccucuga

SEQ ID NO: 88575 - RNA, 1755 nt, Artificial Sequence
  derived and/or modified sequence opt1 from hemagglutinin__InfluenzaB__AGX22282
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88576 - RNA, 1755 nt, Artificial Sequence; identical to SEQ ID NO: 88031
  derived and/or modified sequence opt1 from hemagglutinin__InfluenzaB__AGX22293

SEQ ID NO: 88577 - RNA, 1755 nt, Artificial Sequence
  derived and/or modified sequence opt1 from hemagglutinin__InfluenzaB__AGX22304
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcaccaacggggugaccacccacuacgugucccagaucggcggcuuccccgaccagacggaggacgggggccucccgcagagcgggcgcaucgucguggacuacaugaugcagaagcccggcaagaccgggaccaucguguaccagcggggcguccugcugccccagaagguguggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucacgaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcgcuggagcggaagcugaagaagaugcuggggcccuccgccguggacaucggcaacgggugcuucgagaccaagcacaagugcaaccagaccugccucgaccgcaucgccgccggcaccuucaacgcgggggaguucagccugcccacguucgacucccugaacaucaccgccgccagccucaacgacgacggccuggacaaccacaccauccugcuguacuacuccaccgccgccagcucccucgcggugacgcugaugcuggccaucuucaucgucuacauggugagccgggacaacguguccugcagcaucugccucuga

SEQ ID NO: 88578 - RNA, 1755 nt, Artificial Sequence; identical to SEQ ID NO: 88031
  derived and/or modified sequence opt1 from hemagglutinin__InfluenzaB__AGX22315

SEQ ID NO: 88579 - RNA, 1755 nt, Artificial Sequence; identical to SEQ ID NO: 87434
  derived and/or modified sequence opt1 from hemagglutinin__InfluenzaB__AGX22326

SEQ ID NO: 88580 - RNA, 1755 nt, Artificial Sequence; identical to SEQ ID NO: 88034
  derived and/or modified sequence opt1 from hemagglutinin__InfluenzaB__AGX22337

SEQ ID NO: 88581 - RNA, 1755 nt, Artificial Sequence; identical to SEQ ID NO: 88034
  derived and/or modified sequence opt1 from hemagglutinin__InfluenzaB__AGX22348

SEQ ID NO: 88582 - RNA, 1755 nt, Artificial Sequence
  derived and/or modified sequence opt1 from hemagglutinin__InfluenzaB__AGX22359
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgcccagaccgaggacgggggccucccgcagagcgggcgcaucgugguggacuacaugguccagaagcccaagaagacgggcaccaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgagaucaagaaccugcagcggcugagcggggccauggacgagcuccacaacgagauccuggagcuggacgagaaggucgacgaccuccgcgcggacacgaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugcuggccaucuucaucguguacauggugagccgggacaacgucuccugcagcaucugccucuga

SEQ ID NO: 88583 - RNA, 1755 nt, Artificial Sequence; identical to SEQ ID NO: 88032
  derived and/or modified sequence opt1 from hemagglutinin__InfluenzaB__AGX22370

SEQ ID NO: 88584 - RNA, 1755 nt, Artificial Sequence
  derived and/or modified sequence opt1 from hemagglutinin__InfluenzaB__AGX22381
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugagcaaccuccugcggggguacgagaacauccgccuguccacccagaacgugaucgacgcggagaaggcccccggcgggccguaccggcucggcacgagcggguccugccccaacgccaccagcaaguccggcuucuucgccaccauggcgugggccguccccaaggacaacaacaagaacgccaccaacccccugacgguggaggugccguacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccccaguccgggcgcaucgucguggacuacaugaugcagaagccgggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcagcaucugccucuga

SEQ ID NO: 88585 - RNA, 1755 nt, Artificial Sequence; identical to SEQ ID NO: 88031
  derived and/or modified sequence opt1 from hemagglutinin__InfluenzaB__AGX22392

SEQ ID NO: 88586 - RNA, 1755 nt, Artificial Sequence
  derived and/or modified sequence opt1 from hemagglutinin__InfluenzaB__AGX22403
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggacuucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88587 - RNA, 1755 nt, Artificial Sequence; identical to SEQ ID NO: 88031
  derived and/or modified sequence opt1 from hemagglutinin__InfluenzaB__AGX22414

SEQ ID NO: 88588 - RNA, 1755 nt, Artificial Sequence
  derived and/or modified sequence opt1 from hemagglutinin__InfluenzaB__AGX22425
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagauccagaugaagaaccuguacggcgacagcaacccccagaaguucaccuccagcgccaacggggugacgacccacuacgugucccagaucggcggcuuccccgaccagaccgaggacgggggccucccgcagagcgggcgcaucgucguggacuacaugaugcagaagcccggcaagaccgggacgaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcuggggcccuccgccguggagaucggcaacgggugcuucgagacgaagcacaagugcaaccagaccugccucgaccgcaucgccgcgggcaccuucaacgccggggaguucagccugcccaccuucgacucccugaacaucaccgccgccagccucaacgacgacggccuggacaaccacacgauccugcuguacuacuccaccgccgcgagcucccucgccgugacccugaugcuggccaucuucaucgucuacauggugagccgggacaacguguccugcagcaucugccucuga

SEQ ID NO: 88589 - RNA, 1755 nt, Artificial Sequence; identical to SEQ ID NO: 88032
  derived and/or modified sequence opt1 from hemagglutinin__InfluenzaB__AGX22436

SEQ ID NO: 88590 - RNA, 1755 nt, Artificial Sequence; identical to SEQ ID NO: 88032
  derived and/or modified sequence opt1 from hemagglutinin__InfluenzaB__AGX22445

SEQ ID NO: 88591 - RNA, 1755 nt, Artificial Sequence
  derived and/or modified sequence opt1 from hemagglutinin__InfluenzaB__AGX22456
augaaggccaucaucgugcugcucauggucgugaccagcaacgccgaccgcaucugcaccggcaucacguccagcuccagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccgagcgccaaggccuccauccugcacgagguccgccccgugaccagcggcugcuuccccaucaugcacgaccggaccaagauccgccagcugcccaaccuccugcggggguacgagaacauccgccuguccacccagaacgugaucgacgcggagaaggccccgggcgggcccuaccggcucggcacgagcggguccugccccaacgccaccagcaaguccggcuucuucgccaccauggcgugggccguccccaaggacaacaacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccgcaguccgggcgcaucgucguggacuacaugaugcagaagcccggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacagcgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacaucgugagccgggacaacgugagcugcuccaucugccucuga

SEQ ID NO: 88592 - RNA, 1755 nt, Artificial Sequence; identical to SEQ ID NO: 88031
  derived and/or modified sequence opt1 from hemagglutinin__InfluenzaB__AGX22467

SEQ ID NO: 88593 - RNA, 1755 nt, Artificial Sequence; identical to SEQ ID NO: 88031
  derived and/or modified sequence opt1 from hemagglutinin__InfluenzaB__AGX22478

SEQ ID NO: 88594 - RNA, 1755 nt, Artificial Sequence
  derived and/or modified sequence opt1 from hemagglutinin__InfluenzaB__AGX22489
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccaguccgcgaucgacgccgagaaggccccgggcgggcccuaccggcucggcacgagcggguccugccccaacgccaccagcaaguccggcuucuucgcgaccauggccugggccgugcccaaggacaacaacaagaacgccaccaacccgcugacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcggcuuccccgggcagaccgaggacggcgggcucccgcaguccggccgcaucguggucgacuacaugauccagaagcccgggaagacgggcaccaucguguaccagcggggcgugcugcugccccagaaggucuggugcgcgagcgggcgcagcaaggugaucaagggcucccucccccugaucggggaggccgacugccugcacgagaaguacggcgggcucaacaagagcaagccguacuacaccggcgagcacgccaaggccaucggcaacugccccaucugggugaagacgccccugaagcuggccaacgggaccaaguaccggcccccggcgaagcuccugaaggagcgcggcuucuucggggccaucgccggcuuccuggagggcgggugggagggcaugaucgccggguggcacggcuacaccucccacggggcccacggcgucgcgguggccgccgaccucaagagcacccaggaggccaucaacaagaucaccaagaaccugaacucccugagcgagcucgaggucaagaaccugcagcggcuguccggcgccauggacgagcuccacaacgagauccuggagcuggacgagaagguggacgaccuccgcgcggacacgaucagcgcccagaucgagcuggccgugcugcucuccaacgaggggaucaucaacagcgaggacgagcaccuccuggcccuggagcggaagcugaagaagaugcugggccccuccgcggucgacaucgggaacggcugcuucgagaccaagcacaagugcaaccagaccugccucgaccgcaucgccgccgggaccuucaacgccggcgaguucagccugcccaccuucgacucccugaacaucacggccgcgagccucaacgacgacggccuggacaaccacaccauccugcuguacuacuccaccgccgccagcucccucgccgugacccugaugcuggccaucuucaucguguacauggucagccgggacaacguguccugcagcaucugccucuga

SEQ ID NO: 88595 - RNA, 1755 nt, Artificial Sequence
  derived and/or modified sequence opt1 from hemagglutinin__InfluenzaB__AGX22500
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgcccagaccgaggacgggggccucccgcagagcgggcgcaucaucgucgacuacauggugcagaagccccggaagacgggcaccaucguguaccagcgcgggguccugcugccccagaagguguggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccguggcgagcucccucgccgucacccugaugcuggccaucuucaucguguacauggugagccgcgacaacgucuccugcagcaucugccucuga

SEQ ID NO: 88596 - RNA, 1755 nt, Artificial Sequence; identical to SEQ ID NO: 88032
  derived and/or modified sequence opt1 from hemagglutinin__InfluenzaB__AGX22511

SEQ ID NO: 88597 - RNA, 1755 nt, Artificial Sequence
  derived and/or modified sequence opt1 from hemagglutinin__InfluenzaB__AGX22522
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccaagcacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88598 - RNA, 1755 nt, Artificial Sequence; identical to SEQ ID NO: 87434
  derived and/or modified sequence opt1 from hemagglutinin__InfluenzaB__AGX22533

SEQ ID NO: 88599 - RNA, 1755 nt, Artificial Sequence; identical to SEQ ID NO: 88046
  derived and/or modified sequence opt1 from hemagglutinin__InfluenzaB__AGX22566

SEQ ID NO: 88600 - RNA, 1755 nt, Artificial Sequence; identical to SEQ ID NO: 88032
  derived and/or modified sequence opt1 from hemagglutinin__InfluenzaB__AGX22577

SEQ ID NO: 88601 - RNA, 1755 nt, Artificial Sequence; identical to SEQ ID NO: 88046
  derived and/or modified sequence opt1 from hemagglutinin__InfluenzaB__AGX22588

SEQ ID NO: 88602 - RNA, 1755 nt, Artificial Sequence; identical to SEQ ID NO: 87434
  derived and/or modified sequence opt1 from hemagglutinin__InfluenzaB__AGX22599

SEQ ID NO: 88603 - RNA, 1755 nt, Artificial Sequence
  derived and/or modified sequence opt1 from hemagglutinin__InfluenzaB__AGX22610
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgaccccaacccccagaaguucacgagcuccgccaacggggugaccacccacuacgugagccagaucggcggcuucccggaccagaccgaggacgggggccucccccaguccgggcgcaucgucguggacuacaugaugcagaagcccggcaagacggggaccaucguguaccagcggggcguccugcugccccagaagguguggugcgccagcggccgcuccaaggugaucaaggggagccucccgcugaucggcgaggcggacugccugcacgagaaguacgggggccucaacaagagcaagcccuacuacaccggggagcacgccaaggccaucggcaacugccccaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 88604 - RNA, 1755 nt, Artificial Sequence
  derived and/or modified sequence opt1 from hemagglutinin__InfluenzaB__AGX22621
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccggcggggaggaccagaucaccgucuggggcuuccacuccgacaacaagacccagaugaagaaccuguacggggacagcaacccccagaaguucacguccagcgccaacggcgugaccacccacuacgugucccagaucggcggguuccccgaccagaccgaggacggcgggcucccccagagcggccgcaucgucguggacuacaugaugcagaagccggggaagacgggcaccaucguguaccagcggggcguccugcugccccagaagguguggugcgcguccgggcgcagcaaggugaucaagggcagccucccccugaucggggaggccgacugccugcacgagaaguacggcgggcucaacaaguccaagcccuacuacaccggcgagcacgccaaggccaucggcaacugcccgaucugggucaagacgccccugaagcuggccaacgggaccaaguaccggccgcccgcgaagcuccugaaggagcgcggcuucuucggggccaucgccggcuuccuggagggcgggugggagggcaugaucgccggguggcacggcuacaccagccacggggcccacggcguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgaggggaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88605 - RNA, 1755 nt, Artificial Sequence; identical to SEQ ID NO: 87434
  derived and/or modified sequence opt1 from hemagglutinin__InfluenzaB__AGX22632

SEQ ID NO: 88606 - RNA, 1755 nt, Artificial Sequence
  derived and/or modified sequence opt1 from hemagglutinin__InfluenzaB__AGX22643
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcauccagaacgugaucgacgccgagaaggcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88607 - RNA, 1755 nt, Artificial Sequence
  derived and/or modified sequence opt1 from hemagglutinin__InfluenzaB__AGX22654
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacuccgagauccuggagcuggacgagaagguggacgaccuccgcgcggacacgaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugucccgggacaacgugagcugcagcaucugccucuga

SEQ ID NO: 88608 - RNA, 1755 nt, Artificial Sequence; identical to SEQ ID NO: 88046
  derived and/or modified sequence opt1 from hemagglutinin__InfluenzaB__AGX22665

SEQ ID NO: 88609 - RNA, 1755 nt, Artificial Sequence; identical to SEQ ID NO: 88046
  derived and/or modified sequence opt1 from hemagglutinin__InfluenzaB__AGX22676

SEQ ID NO: 88610 - RNA, 1755 nt, Artificial Sequence; identical to SEQ ID NO: 87434
  derived and/or modified sequence opt1 from hemagglutinin__InfluenzaB__AGX22687

SEQ ID NO: 88611 - RNA, 1755 nt, Artificial Sequence; identical to SEQ ID NO: 88046
  derived and/or modified sequence opt1 from hemagglutinin__InfluenzaB__AGX22698

SEQ ID NO: 88612 - RNA, 1755 nt, Artificial Sequence
  derived and/or modified sequence opt1 from hemagglutinin__InfluenzaB__AGX22709
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccggagaagacgggcaccaucguguaccagcgcgggguccugcugccccagaagguguggugcgcguccggccggagcaaggugaucaagggcagccucccccugaucggggaggccgacugccugcacgagaaguacggcgggcucaacaaguccaagcccuacuacaccggcgagcacgccaaggccaucgggaacugcccgaucugggucaagacgccccugaagcuggccaacggcaccaaguaccggccgcccgcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88613 - RNA, 1755 nt, Artificial Sequence
  derived and/or modified sequence opt1 from hemagglutinin__InfluenzaB__AGX22720
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggccaccacccacuacgugucccagaucggcggcuuccccgaccagaccgaggacgggggccucccgcagagcgggcgcaucguggucgacuacaugaugcagaagcccggcaagacggggaccaucguguaccagcggggcgugcugcugccccagaaggucuggugcgcguccggccgcagcaaggugaucaaggggagccucccccugaucggcgaggccgacugccugcacgagaaguacgggggccucaacaaguccaagccguacuacaccggggagcacgccaaggccaucggcaacugccccaucugggugaagacgccccugaagcuggccaacggcaccaaguaccggcccccggcgaagcuccugaaggagcgcggguucuucggcgccaucgccggguuccuggagggcgggugggagggcaugaucgccggcuggcacggguacaccagccacggcgcccacggggucgcgguggccgccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgcggacacgaucuccagccagaucgagcuggccgugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucguguacauggucagccgggacaacguguccugcagcaucugccucuga

SEQ ID NO: 88614 - RNA, 1755 nt, Artificial Sequence; identical to SEQ ID NO: 88046
  derived and/or modified sequence opt1 from hemagglutinin__InfluenzaB__AGX22731

SEQ ID NO: 88615 - RNA, 1755 nt, Artificial Sequence; identical to SEQ ID NO: 88607
  derived and/or modified sequence opt1 from hemagglutinin__InfluenzaB__AGX22742

SEQ ID NO: 88616 - RNA, 1755 nt, Artificial Sequence
  derived and/or modified sequence opt1 from hemagglutinin__InfluenzaB__AGX22753
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcuggccaaccuccugcggggguacgagaacauccgccugagcacccagaacgugaucgacgccgagaaggcccccggcgggccguaccggcucggcaccuccgggagcugccccaacgcgacguccaagagcggcuucuucgccaccauggccugggccguccccaaggacaacaacaagaacgccaccaacccccugaccguggaggugccguacaucugcaaggagggcgaggaccagaucacggucuggggguuccacuccgacaacaagacccagaugaagaaccuguacggcgacagcaacccccagaaguucaccuccagcgcgaacggggugaccacgcacuacgugucccagaucggcggcuuccccgaccagaccgaggacgggggccucccccagagcgggcgcaucgucguggacuacaugauccagaagccgggcaagaccgggaccaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagaccaagcacaagugcaaccagacgugccucgaccgcaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacauggugagccgggacaacguguccugcagcaucugccucuga

SEQ ID NO: 88617 - RNA, 1755 nt, Artificial Sequence
  derived and/or modified sequence opt1 from hemagglutinin__InfluenzaB__AGX22764
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggaccacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88618 - RNA, 1755 nt, Artificial Sequence
  derived and/or modified sequence opt1 from hemagglutinin__InfluenzaB__AGX22775
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggcgccugaagaagaugcuggggcccuccgccguggagaucggcaacgggugcuucgagaccaagcacaagugcaaccagaccugccucgaccggaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgcgacaacguguccugcagcaucugccucuga

SEQ ID NO: 88619 - RNA, 1755 nt, Artificial Sequence; identical to SEQ ID NO: 88046
  derived and/or modified sequence opt1 from hemagglutinin__InfluenzaB__AGX22786

SEQ ID NO: 88620 - RNA, 1755 nt, Artificial Sequence
  derived and/or modified sequence opt1 from hemagglutinin__InfluenzaB__AGX22797
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugauccagaagccgggcaagaccgggacgaucguguaccagcggggcguccuguucccccagaagguguggugcgcguccggccgcagcaaggugaucaaggggagccugccccucaucggcgaggccgacugccugcacgagaaguacgggggccugaacaaguccaagcccuacuacaccggggagcacgccaaggccaucggcaacugcccgaucugggucaagacgccccucaagcuggccaacggcaccaaguaccggccgcccgcgaagcugcucaaggagcgcggguucuucggcgccaucgccggguuccuggagggcgggugggagggcaugaucgccggcuggcacggguacaccagccacggcgcccacgggguggcggucgccgccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgcggacaccaucuccagccagaucgagcucgccguccugcuguccaacgagggcaucaucaacagcgaggacgagcaccuccuggcccuggagcggaagcucaagaagaugcuggggcccuccgccguggacaucggcaacgggugcuucgagacgaagcacaagugcaaccagaccugccuggaccgcaucgcggccggcaccuucaacgccggggaguucagccuccccaccuucgacucccugaacaucaccgccgccagccugaacgacgacggccucgacaaccacacgauccugcuguacuacuccaccgcggccagcucccuggccgugacccucaugcuggccaucuucaucgucuacauggugagccgggacaacguguccugcagcaucugccuguga

SEQ ID NO: 88621 - RNA, 1755 nt, Artificial Sequence; identical to SEQ ID NO: 88046
  derived and/or modified sequence opt1 from hemagglutinin__InfluenzaB__AGX22808

SEQ ID NO: 88622 - RNA, 1755 nt, Artificial Sequence; identical to SEQ ID NO: 88046
  derived and/or modified sequence opt1 from hemagglutinin__InfluenzaB__AGX22819

SEQ ID NO: 88623 - RNA, 1755 nt, Artificial Sequence; identical to SEQ ID NO: 88046
  derived and/or modified sequence opt1 from hemagglutinin__InfluenzaB__AGX22830

SEQ ID NO: 88624 - RNA, 1755 nt, Artificial Sequence
  derived and/or modified sequence opt1 from hemagglutinin__InfluenzaB__AGX22841
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccgacggggugacgacccacuacgugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88625 - RNA, 1755 nt, Artificial Sequence; identical to SEQ ID NO: 87434
  derived and/or modified sequence opt1 from hemagglutinin__InfluenzaB__AGX22852

SEQ ID NO: 88626 - RNA, 1755 nt, Artificial Sequence; identical to SEQ ID NO: 88046
  derived and/or modified sequence opt1 from hemagglutinin__InfluenzaB__AGX22863

SEQ ID NO: 88627 - RNA, 1755 nt, Artificial Sequence; identical to SEQ ID NO: 88046
  derived and/or modified sequence opt1 from hemagglutinin__InfluenzaB__AGX22874

SEQ ID NO: 88628 - RNA, 1755 nt, Artificial Sequence; identical to SEQ ID NO: 87434
  derived and/or modified sequence opt1 from hemagglutinin__InfluenzaB__AGX22885

SEQ ID NO: 88629 - RNA, 1755 nt, Artificial Sequence; identical to SEQ ID NO: 88607
  derived and/or modified sequence opt1 from hemagglutinin__InfluenzaB__AGX22896

SEQ ID NO: 88630 - RNA, 1755 nt, Artificial Sequence
  derived and/or modified sequence opt1 from hemagglutinin__InfluenzaB__AGX22907
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacuccgugagcugcagcaucugccucuga

SEQ ID NO: 88631 - RNA, 1755 nt, Artificial Sequence; identical to SEQ ID NO: 87434
  derived and/or modified sequence opt1 from hemagglutinin__InfluenzaB__AGX22918

SEQ ID NO: 88632 - RNA, 1755 nt, Artificial Sequence; identical to SEQ ID NO: 87434
  derived and/or modified sequence opt1 from hemagglutinin__InfluenzaB__AGX22929

SEQ ID NO: 88633 - RNA, 1755 nt, Artificial Sequence; identical to SEQ ID NO: 88046
  derived and/or modified sequence opt1 from hemagglutinin__InfluenzaB__AGX22940

SEQ ID NO: 88634 - RNA, 1755 nt, Artificial Sequence; identical to SEQ ID NO: 87434
  derived and/or modified sequence opt1 from hemagglutinin__InfluenzaB__AGX22951

SEQ ID NO: 88635 - RNA, 1755 nt, Artificial Sequence; identical to SEQ ID NO: 87434
  derived and/or modified sequence opt1 from hemagglutinin__InfluenzaB__AGX22962

SEQ ID NO: 88636 - RNA, 1755 nt, Artificial Sequence; identical to SEQ ID NO: 87434
  derived and/or modified sequence opt1 from hemagglutinin__InfluenzaB__AGX22973

SEQ ID NO: 88637 - RNA, 1755 nt, Artificial Sequence; identical to SEQ ID NO: 87434
  derived and/or modified sequence opt1 from hemagglutinin__InfluenzaB__AGX22984

SEQ ID NO: 88638 - RNA, 1755 nt, Artificial Sequence; identical to SEQ ID NO: 87434
  derived and/or modified sequence opt1 from hemagglutinin__InfluenzaB__AGX22995

SEQ ID NO: 88639 - RNA, 1755 nt, Artificial Sequence; identical to SEQ ID NO: 87434
  derived and/or modified sequence opt1 from hemagglutinin__InfluenzaB__AGX23006

SEQ ID NO: 88640 - RNA, 1755 nt, Artificial Sequence
  derived and/or modified sequence opt1 from hemagglutinin__InfluenzaB__AGX23017
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagauccgccccgucaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccgugcccaaggacaacaacaagaacgccaccaacccccugacggucgaggugccguacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgaccagaccgaggacgggggccucccccagagcgggcgcaucguggucgacuacaugaugcagaagccgggcaagacggggaccaucguguaccagcggggcgugcugcugccccagaaggucuggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacggggucgcgguggccgccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgcggacacgaucuccagccagaucgagcuggccgugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucguguacauggucagccgggacaacguguccugcagcaucugccucuga

SEQ ID NO: 88641 - RNA, 1755 nt, Artificial Sequence
  derived and/or modified sequence opt1 from hemagglutinin__InfluenzaB__AGX23028
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguacaagcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88642 - RNA, 1755 nt, Artificial Sequence; identical to SEQ ID NO: 87434
  derived and/or modified sequence opt1 from hemagglutinin__InfluenzaB__AGX23039

SEQ ID NO: 88643 - RNA, 1755 nt, Artificial Sequence
  derived and/or modified sequence opt1 from hemagglutinin__InfluenzaB__AGX23050
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgaggucucccccgugaccagcggcugcuuccccaucaugcacgaccgcaccaagauccggcagcuggcgaaccuccugcgcggguacgagaacauccggcuguccacccagaacgugaucgacgccgagaaggcccccggcgggccguaccgccucggcacgagcggguccugccccaacgccaccagcaaguccggcuucuucgcgaccauggccugggccguccccaaggacaacaacaagaacgccaccaacccccugacgguggaggugccguacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccccaguccgggcggaucgucguggacuacaugaugcagaagccgggcaagacggggaccaucguguaccagcgcggcguccugcugccccagaagguguggugcgcgagcggccggagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugcgccuggccaacggcaccaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacacgaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugucccgggacaacgugagcugcagcaucugccucuga

SEQ ID NO: 88644 - RNA, 1755 nt, Artificial Sequence
  derived and/or modified sequence opt1 from hemagglutinin__InfluenzaB__AGX23061
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugcggcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccucuga

SEQ ID NO: 88645 - RNA, 1755 nt, Artificial Sequence; identical to SEQ ID NO: 87434
  derived and/or modified sequence opt1 from hemagglutinin__InfluenzaB__AGX23072

SEQ ID NO: 88646 - RNA, 1755 nt, Artificial Sequence; identical to SEQ ID NO: 88046
  derived and/or modified sequence opt1 from hemagglutinin__InfluenzaB__AGX23083

SEQ ID NO: 88647 - RNA, 1755 nt, Artificial Sequence; identical to SEQ ID NO: 87434
  derived and/or modified sequence opt1 from hemagglutinin__InfluenzaB__AGX23094

SEQ ID NO: 88648 - RNA, 1755 nt, Artificial Sequence; identical to SEQ ID NO: 87434
  derived and/or modified sequence opt1 from hemagglutinin__InfluenzaB__AGX23105

SEQ ID NO: 88649 - RNA, 1755 nt, Artificial Sequence; identical to SEQ ID NO: 88046
  derived and/or modified sequence opt1 from hemagglutinin__InfluenzaB__AGX23116

SEQ ID NO: 88650 - RNA, 1755 nt, Artificial Sequence; identical to SEQ ID NO: 87434
  derived and/or modified sequence opt1 from hemagglutinin__InfluenzaB__AGX23127

SEQ ID NO: 88651 - RNA, 1755 nt, Artificial Sequence; identical to SEQ ID NO: 87434
  derived and/or modified sequence opt1 from hemagglutinin__InfluenzaB__AGX23138

SEQ ID NO: 88652 - RNA, 1755 nt, Artificial Sequence
  derived and/or modified sequence opt1 from hemagglutinin__InfluenzaB__AGX23149
augaaggccaucaucgugcugcucauggucgugaccagcaacgccgaccgcaucugcaccggcaucacguccagcgacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88653 - RNA, 1755 nt, Artificial Sequence
  derived and/or modified sequence opt1 from hemagglutinin__InfluenzaB__AGX23160
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaucaccccguccgccaaggccagcauccugcacgagguccgccccgugacguccggcugcuuccccaucaugcacgaccggaccaagauccgccagcuggcgaaccuccugcggggguacgagaacauccgccugagcacccagaacgugaucgacgccgagaaggcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagcgcuucaccuccagcgccaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugcgccuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88654 - RNA, 1755 nt, Artificial Sequence
  derived and/or modified sequence opt1 from hemagglutinin__InfluenzaB__AGX23171
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagcgcuucacguccagcgccaacggggugaccacccacuacgugucccagaucggcggcuuccccgaccagaccgaggacgggggccucccccagagcgggcggaucgucguggacuacaugaugcagaagccgggcaagacggggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugcgccuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88655 - RNA, 1755 nt, Artificial Sequence; identical to SEQ ID NO: 87434
  derived and/or modified sequence opt1 from hemagglutinin__InfluenzaB__AGX23182

SEQ ID NO: 88656 - RNA, 1755 nt, Artificial Sequence; identical to SEQ ID NO: 87434
  derived and/or modified sequence opt1 from hemagglutinin__InfluenzaB__AGX23193

SEQ ID NO: 88657 - RNA, 1755 nt, Artificial Sequence; identical to SEQ ID NO: 88046
  derived and/or modified sequence opt1 from hemagglutinin__InfluenzaB__AGX23204

SEQ ID NO: 88658 - RNA, 1755 nt, Artificial Sequence; identical to SEQ ID NO: 87434
  derived and/or modified sequence opt1 from hemagglutinin__InfluenzaB__AGX23215

SEQ ID NO: 88659 - RNA, 1755 nt, Artificial Sequence
  derived and/or modified sequence opt1 from hemagglutinin__InfluenzaB__AGX23226
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccuccggggugacgacccacuacgugagccagaucggcggcuuccccgaccagaccgaggacgggggccucccccaguccgggcgcaucgucguggacuacaugauccagaagccgggcaagaccgggacgaucguguaccagcggggcguccugcugccccagaagguguggugcgcgagcggccgcagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagacgaagcacaagugcaaccagaccugccucgaccgcaucgcggccggcaccuucaacgccggggaguucucccugcccaccuucgacagccugaacaucaccgccgccucccucaacgacgacggccuggacaaccacacgauccugcuguacuacagcaccgcggccuccagccucgccgugacccugaugcuggccaucuucaucgucuacauggugucccgggacaacgugagcugcagcaucugccucuga

SEQ ID NO: 88660 - RNA, 1755 nt, Artificial Sequence; identical to SEQ ID NO: 88607
  derived and/or modified sequence opt1 from hemagglutinin__InfluenzaB__AGX23237

SEQ ID NO: 88661 - RNA, 1755 nt, Artificial Sequence
  derived and/or modified sequence opt1 from hemagglutinin__InfluenzaB__AGX23248
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaaggagggcgaggaccagaucaccgucuggggguuccacuccgacaacaagacccagaugaagaaccuguacggcgacagcaacccccagaaguucaccuccagcgccuccggggugacgacccacuacgugagccagaucggcggcuuccccgaccagaccgaggacgggggccucccccaguccgggcgcaucgucguggacuacaugauccagaagccgggcaagaccgggacgaucguguaccagcggggcguccugcugccccagaagguguggugcgcgagcggccgcagcaaggugaucaaggggucccucccccugaucggcgaggccgacugccugcacgagaaguacgggggccucaacaagagcaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagacgaagcacaagugcaaccagaccugccucaaccgcaucgcggccggcaccuucaacgccggggaguucucccugcccaccuucgacagccugaacaucaccgccgccucccucaacgacgacggccuggacaaccacacgauccugcuguacuacagcaccgcggccuccagccucgccgugacccugaugcuggccaucuucaucgucuacauggugucccgggacaacgugagcugcagcaucugccucuga

SEQ ID NO: 88662 - RNA, 1755 nt, Artificial Sequence; identical to SEQ ID NO: 87434
  derived and/or modified sequence opt1 from hemagglutinin__InfluenzaB__AGX23259

SEQ ID NO: 88663 - RNA, 1755 nt, Artificial Sequence; identical to SEQ ID NO: 87434
  derived and/or modified sequence opt1 from hemagglutinin__InfluenzaB__AGX23270

SEQ ID NO: 88664 - RNA, 1755 nt, Artificial Sequence
  derived and/or modified sequence opt1 from hemagglutinin__InfluenzaB__AGX23281
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccgcguccaagagcggcuucuucgccaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacuccgagauccuggagcuggacgagaagguggacgaccuccgcgccgacaccaucagcucccagaucgagcuggccguccugcucagcaacgagggcaucaucaacuccgaggacgagcaccuccuggcccuggagcggaagcugaagaagaugcuggggcccagcgcgguggacaucggcaacgggugcuucgagacgaagcacaagugcaaccagaccugccucgaccgcaucgccgccggcaccuucaacgccggggaguucucccugcccaccuucgacagccugaacaucaccgccgcgucccucaacgacgacggccuggacaaccacacgauccugcuguacuacagcaccgccgccuccagccucgccgugacccugaugcuggccaucuucaucgucuacauggugucccgggacaacgugagcugcagcaucugccucuga

SEQ ID NO: 88665 - RNA, 1755 nt, Artificial Sequence
  derived and/or modified sequence opt1 from hemagglutinin__InfluenzaB__AGX23292
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaacuccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacaccaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgggacaacguguccugcagcaucugccucuga

SEQ ID NO: 88666 - RNA, 1755 nt, Artificial Sequence
  derived and/or modified sequence opt1 from hemagglutinin__InfluenzaB__AGX23314
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagcgggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcggaucgucguggacuacaugaugcagaagccgggcaagacggggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccucuga

SEQ ID NO: 88667 - RNA, 1755 nt, Artificial Sequence; identical to SEQ ID NO: 88666
  derived and/or modified sequence opt1 from hemagglutinin__InfluenzaB__AGX23325

SEQ ID NO: 88668 - RNA, 1755 nt, Artificial Sequence; identical to SEQ ID NO: 88666
  derived and/or modified sequence opt1 from hemagglutinin__InfluenzaB__AGX23336

SEQ ID NO: 88669 - RNA, 1755 nt, Artificial Sequence; identical to SEQ ID NO: 88666
  derived and/or modified sequence opt1 from hemagglutinin__InfluenzaB__AGX23347

SEQ ID NO: 88670 - RNA, 1755 nt, Artificial Sequence; identical to SEQ ID NO: 88666
  derived and/or modified sequence opt1 from hemagglutinin__InfluenzaB__AGX23358

SEQ ID NO: 88671 - RNA, 1755 nt, Artificial Sequence; identical to SEQ ID NO: 88666
  derived and/or modified sequence opt1 from hemagglutinin__InfluenzaB__AGX23369

SEQ ID NO: 88672 - RNA, 1755 nt, Artificial Sequence; identical to SEQ ID NO: 88666
  derived and/or modified sequence opt1 from hemagglutinin__InfluenzaB__AGX23380

SEQ ID NO: 88673 - RNA, 1755 nt, Artificial Sequence; identical to SEQ ID NO: 87434
  derived and/or modified sequence opt1 from hemagglutinin__InfluenzaB__AGX23391

SEQ ID NO: 88674 - RNA, 1755 nt, Artificial Sequence
  derived and/or modified sequence opt1 from hemagglutinin__InfluenzaB__AGX23413
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcaaccagaacgugaucgacgccgagcgggcccccggcgggccguaccgccucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagacgaagcacaagugcaaccagaccugccucgaccggaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgcgacaacguguccugcagcaucugccucuga

SEQ ID NO: 88675 - RNA, 1755 nt, Artificial Sequence; identical to SEQ ID NO: 88674
  derived and/or modified sequence opt1 from hemagglutinin__InfluenzaB__AGX23424

SEQ ID NO: 88676 - RNA, 1755 nt, Artificial Sequence; identical to SEQ ID NO: 87828
  derived and/or modified sequence opt1 from hemagglutinin__InfluenzaB__AGX23435

SEQ ID NO: 88677 - RNA, 1755 nt, Artificial Sequence; identical to SEQ ID NO: 87739
  derived and/or modified sequence opt1 from hemagglutinin__InfluenzaB__AGX23446

SEQ ID NO: 88678 - RNA, 1755 nt, Artificial Sequence; identical to SEQ ID NO: 87828
  derived and/or modified sequence opt1 from hemagglutinin__InfluenzaB__AGX23457

SEQ ID NO: 88679 - RNA, 1755 nt, Artificial Sequence; identical to SEQ ID NO: 87739
  derived and/or modified sequence opt1 from hemagglutinin__InfluenzaB__AGX23468

SEQ ID NO: 88680 - RNA, 1755 nt, Artificial Sequence; identical to SEQ ID NO: 87434
  derived and/or modified sequence opt1 from hemagglutinin__InfluenzaB__AGX23479

SEQ ID NO: 88681 - RNA, 1755 nt, Artificial Sequence; identical to SEQ ID NO: 87434
  derived and/or modified sequence opt1 from hemagglutinin__InfluenzaB__AGX23490

SEQ ID NO: 88682 - RNA, 1755 nt, Artificial Sequence; identical to SEQ ID NO: 88055
  derived and/or modified sequence opt1 from hemagglutinin__InfluenzaB__AGX23501

SEQ ID NO: 88683 - RNA, 1755 nt, Artificial Sequence
  derived and/or modified sequence opt1 from hemagglutinin__InfluenzaB__AGX23512
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagacgcuguacggcgacagcaacccccagaaguucaccuccagcgccaacggggugaccacccacuacgugucccagaucggcggcuuccccgaccagacggaggacgggggccucccccagagcgggcggaucgucguggacuacaugaugcagaagccgggcaagaccgggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucacgaagaaccugaacagccuguccgagcucgaggugaagaaccugcagcgccugagcggcgccauggacgagcuccacaacgagauccuggagcuggacgagaagguggacgaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccacguucgacucccugaacaucaccgccgccagccucaacgacgacggccuggacaaccacaccauccugcuguacuacuccaccgcggccagcucccucgccgugacgcugaugcuggccaucuucaucgucuacauggugagccgcgacaacguguccugcagcaucugccucuga

SEQ ID NO: 88684 - RNA, 1755 nt, Artificial Sequence; identical to SEQ ID NO: 87434
  derived and/or modified sequence opt1 from hemagglutinin__InfluenzaB__AGX23523

SEQ ID NO: 88685 - RNA, 1755 nt, Artificial Sequence; identical to SEQ ID NO: 87739
  derived and/or modified sequence opt1 from hemagglutinin__InfluenzaB__AGX23534

SEQ ID NO: 88686 - RNA, 1755 nt, Artificial Sequence; identical to SEQ ID NO: 87739
  derived and/or modified sequence opt1 from hemagglutinin__InfluenzaB__AGX23545

SEQ ID NO: 88687 - RNA, 1755 nt, Artificial Sequence; identical to SEQ ID NO: 87434
  derived and/or modified sequence opt1 from hemagglutinin__InfluenzaB__AGX23556

SEQ ID NO: 88688 - RNA, 1755 nt, Artificial Sequence; identical to SEQ ID NO: 87434
  derived and/or modified sequence opt1 from hemagglutinin__InfluenzaB__AGX23567

SEQ ID NO: 88689 - RNA, 1755 nt, Artificial Sequence; identical to SEQ ID NO: 87434
  derived and/or modified sequence opt1 from hemagglutinin__InfluenzaB__AGX23578

SEQ ID NO: 88690 - RNA, 1755 nt, Artificial Sequence; identical to SEQ ID NO: 87434
  derived and/or modified sequence opt1 from hemagglutinin__InfluenzaB__AGX23600

SEQ ID NO: 88691 - RNA, 1755 nt, Artificial Sequence
  derived and/or modified sequence opt1 from hemagglutinin__InfluenzaB__AGX23611
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgagaucaagaaccugcagcggcugagcggcgccauggacgagcuccacaacgagauccuggagcuggacgagaagguggacgaccuccgcgcggacacgaucuccagccagaucgagcuggccgugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucguguacauggucagccgggacaacguguccugcagcaucugccucuga

SEQ ID NO: 88692 - RNA, 1755 nt, Artificial Sequence; identical to SEQ ID NO: 87434
  derived and/or modified sequence opt1 from hemagglutinin__InfluenzaB__AGX23622

SEQ ID NO: 88693 - RNA, 1755 nt, Artificial Sequence; identical to SEQ ID NO: 87739
  derived and/or modified sequence opt1 from hemagglutinin__InfluenzaB__AGX23633

SEQ ID NO: 88694 - RNA, 1755 nt, Artificial Sequence; identical to SEQ ID NO: 87739
  derived and/or modified sequence opt1 from hemagglutinin__InfluenzaB__AGX23644

SEQ ID NO: 88695 - RNA, 1755 nt, Artificial Sequence; identical to SEQ ID NO: 87434
  derived and/or modified sequence opt1 from hemagglutinin__InfluenzaB__AGX23655

SEQ ID NO: 88696 - RNA, 1755 nt, Artificial Sequence; identical to SEQ ID NO: 87739
  derived and/or modified sequence opt1 from hemagglutinin__InfluenzaB__AGX23666

SEQ ID NO: 88697 - RNA, 1755 nt, Artificial Sequence
  derived and/or modified sequence opt1 from hemagglutinin__InfluenzaB__AGX23677
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaagauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaucgagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagacgaagcacaagugcaaccagaccugccucgaccggaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgcgacaacguguccugcagcaucugccucuga

SEQ ID NO: 88698 - RNA, 1755 nt, Artificial Sequence; identical to SEQ ID NO: 87739
  derived and/or modified sequence opt1 from hemagglutinin__InfluenzaB__AGX23688

SEQ ID NO: 88699 - RNA, 1755 nt, Artificial Sequence; identical to SEQ ID NO: 87739
  derived and/or modified sequence opt1 from hemagglutinin__InfluenzaB__AGX23699

SEQ ID NO: 88700 - RNA, 1755 nt, Artificial Sequence; identical to SEQ ID NO: 87434
  derived and/or modified sequence opt1 from hemagglutinin__InfluenzaB__AGX23710

SEQ ID NO: 88701 - RNA, 1755 nt, Artificial Sequence; identical to SEQ ID NO: 87739
  derived and/or modified sequence opt1 from hemagglutinin__InfluenzaB__AGX23721

SEQ ID NO: 88702 - RNA, 1755 nt, Artificial Sequence; identical to SEQ ID NO: 87434
  derived and/or modified sequence opt1 from hemagglutinin__InfluenzaB__AGX23732

SEQ ID NO: 88703 - RNA, 1755 nt, Artificial Sequence; identical to SEQ ID NO: 87739
  derived and/or modified sequence opt1 from hemagglutinin__InfluenzaB__AGX23743

SEQ ID NO: 88704 - RNA, 1755 nt, Artificial Sequence; identical to SEQ ID NO: 87739
  derived and/or modified sequence opt1 from hemagglutinin__InfluenzaB__AGX23754

SEQ ID NO: 88705 - RNA, 1755 nt, Artificial Sequence; identical to SEQ ID NO: 87434
  derived and/or modified sequence opt1 from hemagglutinin__InfluenzaB__AGX23765

SEQ ID NO: 88706 - RNA, 1755 nt, Artificial Sequence; identical to SEQ ID NO: 87739
  derived and/or modified sequence opt1 from hemagglutinin__InfluenzaB__AGX23776

SEQ ID NO: 88707 - RNA, 1755 nt, Artificial Sequence; identical to SEQ ID NO: 87739
  derived and/or modified sequence opt1 from hemagglutinin__InfluenzaB__AGX23787

SEQ ID NO: 88708 - RNA, 1755 nt, Artificial Sequence; identical to SEQ ID NO: 87434
  derived and/or modified sequence opt1 from hemagglutinin__InfluenzaB__AGX23798

SEQ ID NO: 88709 - RNA, 1755 nt, Artificial Sequence; identical to SEQ ID NO: 87434
  derived and/or modified sequence opt1 from hemagglutinin__InfluenzaB__AGX23809

SEQ ID NO: 88710 - RNA, 1755 nt, Artificial Sequence; identical to SEQ ID NO: 87434
  derived and/or modified sequence opt1 from hemagglutinin__InfluenzaB__AGX23820

SEQ ID NO: 88711 - RNA, 1755 nt, Artificial Sequence; identical to SEQ ID NO: 87739
  derived and/or modified sequence opt1 from hemagglutinin__InfluenzaB__AGX23831

SEQ ID NO: 88712 - RNA, 1755 nt, Artificial Sequence; identical to SEQ ID NO: 87434
  derived and/or modified sequence opt1 from hemagglutinin__InfluenzaB__AGX23842

SEQ ID NO: 88713 - RNA, 1755 nt, Artificial Sequence
  derived and/or modified sequence opt1 from hemagglutinin__InfluenzaB__AGX23853
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcauccagaacgugaucgacgccgagaaggcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcggcuuccccgaccagaccgaggacgggggccucccccagagcgggcgcaucgucguggacuacaugaugcagaaguccggcaagaccgggacgaucguguaccagcggggcguccugcugccgcagaagguguggugcgcgagcggccgcagcaaggugaucaaggggucccucccccugaucggcgaggccgacugccugcacgagaaguacgggggccucaacaagagcaagcccuacuacaccggggagcacgccaaggccaucggcaacugccccaucugggucaagaccccgcugaagcuggccaacggcaccaaguaccggccgcccgcgaagcuccugaaggagcgcggguucuucggcgccaucgccggguuccuggagggcgggugggagggcaugaucgccggcuggcacggguacacgucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagacgaagcacaagugcaaccagaccugccucgaccgcaucgcggccggcaccuucaacgccggggaguucucccugcccaccuucgacagccugaacaucaccgccgccucccucaacgacgacggccuggacaaccacacgauccugcuguacuacagcaccgcggccuccagccucgccgugacccugaugcuggccaucuucaucgucuacauggugucccgggacaacgugagcugcagcaucugccucuga

SEQ ID NO: 88714 - RNA, 1755 nt, Artificial Sequence; identical to SEQ ID NO: 87434
  derived and/or modified sequence opt1 from hemagglutinin__InfluenzaB__AGX23864

SEQ ID NO: 88715 - RNA, 1755 nt, Artificial Sequence; identical to SEQ ID NO: 87739
  derived and/or modified sequence opt1 from hemagglutinin__InfluenzaB__AGX23875

SEQ ID NO: 88716 - RNA, 1755 nt, Artificial Sequence; identical to SEQ ID NO: 87434
  derived and/or modified sequence opt1 from hemagglutinin__InfluenzaB__AGX23886

SEQ ID NO: 88717 - RNA, 1755 nt, Artificial Sequence
  derived and/or modified sequence opt1 from hemagglutinin__InfluenzaB__AGX23897
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaaguccggcaagacggggaccaucguguaccagcggggcguccugcugccgcagaagguguggugcgcgagcggccgcagcaaggugaucaaggggucccucccccugaucggcgaggccgacugccugcacgagaaguacgggggccucaacaagagcaagcccuacuacaccggggagcacgccaaggccaucggcaacugccccaucugggucaagaccccgcugaagcuggccaacggcacgaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacacgaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugucccgggacaacgugagcugcagcaucugccucuga

SEQ ID NO: 88718 - RNA, 1755 nt, Artificial Sequence
  derived and/or modified sequence opt1 from hemagglutinin__InfluenzaB__AGX23908
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgucaccauggcgugggccgugcccaaggacaacaacaagaacgccaccaacccccugacgguggaggucccguacaucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgaccagaccgaggacgggggccucccccagagcgggcgcaucgugguggacuacaugaugcagaagccgggcaagacggggaccaucgucuaccagcggggcgugcugcugccccagaagguguggugcgccuccggccgcagcaaggucaucaaggggagccucccccugaucggcgaggcggacugccugcacgagaaguacgggggccucaacaaguccaagcccuacuacaccggggagcacgccaaggccaucggcaacugcccgaucugggugaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgucacccugaugcuggccaucuucaucguguacauggugagccgggacaacgucuccugcagcaucugccucuga

SEQ ID NO: 88719 - RNA, 1755 nt, Artificial Sequence; identical to SEQ ID NO: 87575
  derived and/or modified sequence opt1 from hemagglutinin__InfluenzaB__AGX23919

SEQ ID NO: 88720 - RNA, 1755 nt, Artificial Sequence; identical to SEQ ID NO: 88055
  derived and/or modified sequence opt1 from hemagglutinin__InfluenzaB__AGX23930

SEQ ID NO: 88721 - RNA, 1755 nt, Artificial Sequence; identical to SEQ ID NO: 87434
  derived and/or modified sequence opt1 from hemagglutinin__InfluenzaB__AGX23941

SEQ ID NO: 88722 - RNA, 1755 nt, Artificial Sequence; identical to SEQ ID NO: 87739
  derived and/or modified sequence opt1 from hemagglutinin__InfluenzaB__AGX23952

SEQ ID NO: 88723 - RNA, 1755 nt, Artificial Sequence; identical to SEQ ID NO: 87739
  derived and/or modified sequence opt1 from hemagglutinin__InfluenzaB__AGX23963

SEQ ID NO: 88724 - RNA, 1755 nt, Artificial Sequence; identical to SEQ ID NO: 88055
  derived and/or modified sequence opt1 from hemagglutinin__InfluenzaB__AGX23974

SEQ ID NO: 88725 - RNA, 1755 nt, Artificial Sequence; identical to SEQ ID NO: 87575
  derived and/or modified sequence opt1 from hemagglutinin__InfluenzaB__AGX23985

SEQ ID NO: 88726 - RNA, 1755 nt, Artificial Sequence
  derived and/or modified sequence opt1 from hemagglutinin__InfluenzaB__AGX23996
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccaucaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccgugcccaaggacaacaacaagaacgccaccaacccccugacggucgaggugccguacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgaccagaccgaggacgggggccucccccagagcgggcgcaucguggucgacuacaugaugcagaagccgggcaagacggggaccaucguguaccagcggggcgugcugcugccccagaaggucuggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacggggucgcgguggccgccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgcggacacgaucuccagccagaucgagcuggccgugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucguguacauggucagccgggacaacguguccugcagcaucugccucuga

SEQ ID NO: 88727 - RNA, 1755 nt, Artificial Sequence; identical to SEQ ID NO: 88055
  derived and/or modified sequence opt1 from hemagglutinin__InfluenzaB__AGX24007

SEQ ID NO: 88728 - RNA, 1755 nt, Artificial Sequence; identical to SEQ ID NO: 88055
  derived and/or modified sequence opt1 from hemagglutinin__InfluenzaB__AGX24018

SEQ ID NO: 88729 - RNA, 1755 nt, Artificial Sequence
  derived and/or modified sequence opt1 from hemagglutinin__InfluenzaB__AGX24029
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaaggagggcgaggaccagaucaccgucuggggguuccacuccgacaacaagacccagaugaagaaccuguacggcgacagcaacccccagaaguucaccuccagcgccaacggggugacgacccacuacgugucccagaucggcagcuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggagaucgggaacggcugcuucgagacgaagcacaagugcaaccagaccugccucaaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcagcaucugccucuga

SEQ ID NO: 88730 - RNA, 1755 nt, Artificial Sequence; identical to SEQ ID NO: 88055
  derived and/or modified sequence opt1 from hemagglutinin__InfluenzaB__AGX24040

SEQ ID NO: 88731 - RNA, 1755 nt, Artificial Sequence; identical to SEQ ID NO: 87739
  derived and/or modified sequence opt1 from hemagglutinin__InfluenzaB__AGX24051

SEQ ID NO: 88732 - RNA, 1755 nt, Artificial Sequence; identical to SEQ ID NO: 87828
  derived and/or modified sequence opt1 from hemagglutinin__InfluenzaB__AGX24062

SEQ ID NO: 88733 - RNA, 1755 nt, Artificial Sequence; identical to SEQ ID NO: 87575
  derived and/or modified sequence opt1 from hemagglutinin__InfluenzaB__AGX24073

SEQ ID NO: 88734 - RNA, 1755 nt, Artificial Sequence
  derived and/or modified sequence opt1 from hemagglutinin__InfluenzaB__AGX24084
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcaucauccacgagguccgccccgugaccuccggcugcuuccccaucaugcacgaccggaccaagauccgccagcuggcgaaccugcuccggggguacgagaacauccgccugagcacccagaacgugaucgacgccgagaaggcccccggcgggccguaccggcugggcacguccgggagcugccccaacgccaccuccaagagcggcuucuucgcgaccauggccugggccguccccaaggacaacaacaagaacgccaccaacccccucacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccugccccagagcgggcgcaucgucguggacuacaugaugcagaagccgggcaagacggggaccaucguguaccagcggggcguccuccugccccagaagguguggugcgcguccggccgcagcaaggugaucaaggggagccugccccucaucggcgaggccgacugccugcacgagaaguacgggggccugaacaaguccaagcccuacuacaccggggagcacgccaaggccaucggcaacugcccgaucugggucaagacgccccucaagcuggccaacggcaccaaguaccggccgcccgcgaagcugcucaaggagcgcggguucuucggcgccaucgccggguuccuggagggcgggugggagggcaugaucgccggcuggcacggguacaccagccacggcgcccacgggguggcggucgccgccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgcggacacgaucuccagccagaucgagcucgccguccugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgcggccggcaccuucaacgccggggaguucagccuccccaccuucgacucccugaacaucacggccgccagccugaacgacgacggccucgacaaccacaccauccugcuguacuacuccaccgcggccagcucccuggccgugacccucaugcuggccaucuucaucgucuacauggugagccgggacaacguguccugcagcaucugccuguga

SEQ ID NO: 88735 - RNA, 1755 nt, Artificial Sequence; identical to SEQ ID NO: 88055
  derived and/or modified sequence opt1 from hemagglutinin__InfluenzaB__AGX24095

SEQ ID NO: 88736 - RNA, 1755 nt, Artificial Sequence
  derived and/or modified sequence opt1 from hemagglutinin__InfluenzaB__AGX24106
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacaccaccuccaagagcggcuucuucgccaccauggcgugggccguccccaaggacaacaacaagaacgccacgaacccccugaccguggaggugccguacaucugcaccgagggcgaggaccagaucaccgucuggggguuccacuccgacaacaagacgcagaugaagaaccuguacggcgacagcaacccccagaaguucaccuccagcgccaacggggugaccacccacuacgugucccagaucggcggcuuccccgaccagacggaggacgggggccucccccagagcgggcgcaucgucguggacuacaugaugcagaagccgggcaagaccgggaccaucguguaccagcggggcguccugcugccccagaagguguggugcgccuccggccgcagcaaggugaucaaggggagccucccccugaucggcgaggcggacugccugcacgagaaguacgggggccucaacaaguccaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucacgaagaaccugaacagccuguccgagcucgaggugaagaaccugcagcggcugagcggcgccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccacguucgacucccugaacaucaccgccgccagccucaacgacgacggccuggacaaccacaccauccugcuguacuacuccaccgccgcgagcucccucgccgugacgcugaugcuggccaucuucaucgucuacauggugagccgggacaacguguccugcagcaucugccucuga

SEQ ID NO: 88737 - RNA, 1755 nt, Artificial Sequence
  derived and/or modified sequence opt1 from hemagglutinin__InfluenzaB__AGX24117
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacaccaccuccaagagcggcuucuucgccaccauggccugggcgguccccaaggacaacaacaagaacgccacgaacccgcugaccguggaggugcccuacaucugcaccgagggcgaggaccagaucaccgucuggggguuccacuccgacaacaagacgcagaugaagaaccuguacggcgacagcaacccccagaaguucaccuccagcgccaacggggugaccacccacuacgugucccagaucggcagcuuccccgaccagacggaggacggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggccgacugccugcacgagaaguacggcgggcucaacaagagcaagccguacuacaccggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccacggcgucgccguggccgcggaccucaagagcacccaggaggccaucaacaagaucacgaagaaccugaacucccugagcgagcucgaggucaagaaccugcagcggcuguccggggccauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcgcuggagcggaagcugaagaagaugcugggccccagcgccgucgagaucgggaacggcugcuucgagaccaagcacaagugcaaccagaccugccucgaccgcaucgccgccgggaccuucaacgcgggcgaguucucccugcccacguucgacagccugaacaucaccgccgccucccucaacgacgacgggcuggacaaccacaccauccugcuguacuacagcaccgccgccuccagccucgcggugacgcugaugcuggccaucuucaucguguacauggucucccgggacaacgugagcugcagcaucugccucuga

SEQ ID NO: 88738 - RNA, 1755 nt, Artificial Sequence
  derived and/or modified sequence opt1 from hemagglutinin__InfluenzaB__AGX24128
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugcauccacgagaaguacggcgggcugaacaagagcaagccguacuacaccggcgagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccucccacggggcccacggcguggccgucgcggccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcuccaucugccuguga

SEQ ID NO: 88739 - RNA, 1755 nt, Artificial Sequence; identical to SEQ ID NO: 87434
  derived and/or modified sequence opt1 from hemagglutinin__InfluenzaB__AGX24139

SEQ ID NO: 88740 - RNA, 1755 nt, Artificial Sequence
  derived and/or modified sequence opt1 from hemagglutinin__InfluenzaB__AGX24150
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccuacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgggggauccugcugccccagaaggucuggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcagcaucugccucuga

SEQ ID NO: 88741 - RNA, 1755 nt, Artificial Sequence; identical to SEQ ID NO: 88055
  derived and/or modified sequence opt1 from hemagglutinin__InfluenzaB__AGX24161

SEQ ID NO: 88742 - RNA, 1755 nt, Artificial Sequence; identical to SEQ ID NO: 87828
  derived and/or modified sequence opt1 from hemagglutinin__InfluenzaB__AGX24172

SEQ ID NO: 88743 - RNA, 1755 nt, Artificial Sequence; identical to SEQ ID NO: 87828
  derived and/or modified sequence opt1 from hemagglutinin__InfluenzaB__AGX24183

SEQ ID NO: 88744 - RNA, 1755 nt, Artificial Sequence; identical to SEQ ID NO: 87828
  derived and/or modified sequence opt1 from hemagglutinin__InfluenzaB__AGX24194

SEQ ID NO: 88745 - RNA, 1755 nt, Artificial Sequence; identical to SEQ ID NO: 87575
  derived and/or modified sequence opt1 from hemagglutinin__InfluenzaB__AGX24205

SEQ ID NO: 88746 - RNA, 1755 nt, Artificial Sequence; identical to SEQ ID NO: 87739
  derived and/or modified sequence opt1 from hemagglutinin__InfluenzaB__AGX24227

SEQ ID NO: 88747 - RNA, 1755 nt, Artificial Sequence; identical to SEQ ID NO: 87828
  derived and/or modified sequence opt1 from hemagglutinin__InfluenzaB__AGX24238

SEQ ID NO: 88748 - RNA, 1755 nt, Artificial Sequence
  derived and/or modified sequence opt1 from hemagglutinin__InfluenzaB__AGX24249
augaaggccaucaucgugcugcucauggucgugaccagcaacgccgaccgcaucugcaccggcaucacguccagcaagagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 88749 - RNA, 1755 nt, Artificial Sequence; identical to SEQ ID NO: 87575
  derived and/or modified sequence opt1 from hemagglutinin__InfluenzaB__AGX24260

SEQ ID NO: 88750 - RNA, 1755 nt, Artificial Sequence; identical to SEQ ID NO: 88064
  derived and/or modified sequence opt1 from hemagglutinin__InfluenzaB__AGX24271

SEQ ID NO: 88751 - RNA, 1755 nt, Artificial Sequence
  derived and/or modified sequence opt1 from hemagglutinin__InfluenzaB__AGX24282
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccaagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgcgggguccugcugccccagcgcguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 88752 - RNA, 1755 nt, Artificial Sequence; identical to SEQ ID NO: 87575
  derived and/or modified sequence opt1 from hemagglutinin__InfluenzaB__AGX24293

SEQ ID NO: 88753 - RNA, 1755 nt, Artificial Sequence; identical to SEQ ID NO: 87575
  derived and/or modified sequence opt1 from hemagglutinin__InfluenzaB__AGX24304

SEQ ID NO: 88754 - RNA, 1755 nt, Artificial Sequence; identical to SEQ ID NO: 88064
  derived and/or modified sequence opt1 from hemagglutinin__InfluenzaB__AGX24315

SEQ ID NO: 88755 - RNA, 1755 nt, Artificial Sequence
  derived and/or modified sequence opt1 from hemagglutinin__InfluenzaB__AGX24326
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggccgaccugcgugggcacgacccccuccgccaaggccagcauccugcacgagguccgccccgugaccuccggcugcuuccccaucaugcacgaccggaccaagauccgccagcugcccaaccuccugcggggguacgagaacauccgccugagcacgcagaacgugaucgacgcggagaaggccccgggcgggcccuaccggcucggcaccuccgggagcugccccaacgccaccuccaagagcggcuucuucgccaccauggcgugggccguccccaaggacaacaacaagaacgccacgaacccgcugaccguggaggugcccuacaucugcaccgagggcgaggaccagaucaccgucuggggguuccacuccgacaacaagacgcagaugaagaaccuguacggcgacagcaacccccagaaguucaccuccagcgccaacggggugaccacccacuacgugucccagaucggcagcuuccccgaccagacggaggacggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucacgaagaaccugaacucccugagcgagcucgaggucaagaaccugcagcggcuguccggggccauggacgagcuccacaacgagauccuggagcuggacgagaagguggacgaccuccgcgccgacaccaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugcuggccaucuucaucguguacauggucucccgggacaacgugagcugcagcaucugccucuga

SEQ ID NO: 88756 - RNA, 1755 nt, Artificial Sequence
  derived and/or modified sequence opt1 from hemagglutinin__InfluenzaB__AGX24337
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggaugcccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccggaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggacaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcuccaucugccucuga

SEQ ID NO: 88757 - RNA, 1755 nt, Artificial Sequence; identical to SEQ ID NO: 87828
  derived and/or modified sequence opt1 from hemagglutinin__InfluenzaB__AGX24348

SEQ ID NO: 88758 - RNA, 1755 nt, Artificial Sequence; identical to SEQ ID NO: 87575
  derived and/or modified sequence opt1 from hemagglutinin__InfluenzaB__AGX24359

SEQ ID NO: 88759 - RNA, 1755 nt, Artificial Sequence; identical to SEQ ID NO: 87828
  derived and/or modified sequence opt1 from hemagglutinin__InfluenzaB__AGX24381

SEQ ID NO: 88760 - RNA, 1755 nt, Artificial Sequence
  derived and/or modified sequence opt1 from hemagglutinin__InfluenzaB__AGX24392
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggagauccccuacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcagcuuccccgaccagaccgaggacggcgggcucccgcaguccggccgcaucguggucgacuacaugaugcagaagcccgggaagacgggcaccaucguguaccagcgcggggugcugcugccccagaaggucuggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcagcaucugccucuga

SEQ ID NO: 88761 - RNA, 1755 nt, Artificial Sequence; identical to SEQ ID NO: 87575
  derived and/or modified sequence opt1 from hemagglutinin__InfluenzaB__AGX24403

SEQ ID NO: 88762 - RNA, 1755 nt, Artificial Sequence; identical to SEQ ID NO: 87828
  derived and/or modified sequence opt1 from hemagglutinin__InfluenzaB__AGX24414

SEQ ID NO: 88763 - RNA, 1755 nt, Artificial Sequence; identical to SEQ ID NO: 87575
  derived and/or modified sequence opt1 from hemagglutinin__InfluenzaB__AGX24425

SEQ ID NO: 88764 - RNA, 1755 nt, Artificial Sequence; identical to SEQ ID NO: 87575
  derived and/or modified sequence opt1 from hemagglutinin__InfluenzaB__AGX24436

SEQ ID NO: 88765 - RNA, 1755 nt, Artificial Sequence; identical to SEQ ID NO: 88064
  derived and/or modified sequence opt1 from hemagglutinin__InfluenzaB__AGX24447

SEQ ID NO: 88766 - RNA, 1755 nt, Artificial Sequence; identical to SEQ ID NO: 88755
  derived and/or modified sequence opt1 from hemagglutinin__InfluenzaB__AGX24458

SEQ ID NO: 88767 - RNA, 1755 nt, Artificial Sequence
  derived and/or modified sequence opt1 from hemagglutinin__InfluenzaB__AGX24469
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggccgaccugcgugggcacgacccccuccgccaaggccagcauccugcacgagguccgccccgugaccuccggcugcuuccccaucaugcacgaccggaccaagauccgccagcugcccaaccuccugcggggguacgagaacauccgccugagcacgcagaacgugaucgacgcggagaaggccccgggcgggcccuaccggcucggcaccuccgggagcugccccaacgccaccuccaagagcggcuucuucgccaccauggcgugggccguccccaaggacaacaacaagaacgccacgaacccgcugaccguggaggugcccuacaucugcaccgagggcgaggaccagaucaccgucuggggguuccacuccgacaacaagacgcagaugaagaaccuguacggcgacagcaacccccagaaguucaccuccagcgccaacggggugaccacccacuacgugucccagaucggcagcuuccccgaccagacggaggacggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggauggucgccggcuggcacggcuacaccucccacggggcccacggcguggccgucgcggccgaccucaagagcacccaggaggccaucaacaagaucacgaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggagaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugcuggccaucuucaucgucuacauggugucccgggacaacgugagcugcagcaucugccucuga

SEQ ID NO: 88768 - RNA, 1755 nt, Artificial Sequence; identical to SEQ ID NO: 88064
  derived and/or modified sequence opt1 from hemagglutinin__InfluenzaB__AGX24480

SEQ ID NO: 88769 - RNA, 1755 nt, Artificial Sequence; identical to SEQ ID NO: 88064
  derived and/or modified sequence opt1 from hemagglutinin__InfluenzaB__AGX24491

SEQ ID NO: 88770 - RNA, 1755 nt, Artificial Sequence
  derived and/or modified sequence opt1 from hemagglutinin__InfluenzaB__AGX24502
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccagaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccccaguccggccgcaucgucguggacuacaugaugcagaagccggggaagacgggcaccaucguguaccagcgcgggguccugcugccccagcggguguggugcgccagcggccggagcaaggugaucaagggcucccucccccugaucggggaggcggacugccugcacgagaaguacggcgggcucaacaagagcaagcccuacuacaccggcgagcacgccaaggccaucgggaacugcccgaucugggucaagacgccccugaagcuggccaacggcaccaaguaccgcccgcccgccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 88771 - RNA, 1755 nt, Artificial Sequence; identical to SEQ ID NO: 87739
  derived and/or modified sequence opt1 from hemagglutinin__InfluenzaB__AGX24513

SEQ ID NO: 88772 - RNA, 1755 nt, Artificial Sequence; identical to SEQ ID NO: 88064
  derived and/or modified sequence opt1 from hemagglutinin__InfluenzaB__AGX24524

SEQ ID NO: 88773 - RNA, 1755 nt, Artificial Sequence
  derived and/or modified sequence opt1 from hemagglutinin__InfluenzaB__AGX24535
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcgcgcagaucgagcuggccguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88774 - RNA, 1755 nt, Artificial Sequence; identical to SEQ ID NO: 87575
  derived and/or modified sequence opt1 from hemagglutinin__InfluenzaB__AGX24546

SEQ ID NO: 88775 - RNA, 1755 nt, Artificial Sequence
  derived and/or modified sequence opt1 from hemagglutinin__InfluenzaB__AGX24557
augaagaccaucaucgugcugcucauggucgugaccagcaacgccgaccgcaucugcacgggcaucaccuccagcaacagcccccacguggucaagaccgccacccagggggaggugaacgugacgggcgucaucccgcugaccaccacccccaccaaguccuacuucgcgaaccugaaggggacccggacccgcggcaagcucugccccgacugccugaacugcaccgaccuggacguggcccucgggcggcccacgugcgugggcaccaccccguccgccaaggccagcauccugcacgagguccgccccgugaccuccggcugcuuccccaucaugcacgaccggacgaagauccgccagcugcccaaccuccugcggggguacgagaacauccgccugagcacccagaacgugaucgacgccgagaaggcgccgggcgggcccuaccggcucggcaccuccgggagcugccccaacgccaccuccaagagcggcuucuucgccacgauggccugggcgguccccaaggacaacaacaagaacgccaccaacccgcugaccguggaggugcccuacaucugcaccgagggcgaggaccagaucacggucuggggguuccacuccgacaacaagacccagaugaagaaccuguacggcgacagcaacccccagaaguucaccuccagcgccaacggggugaccacgcacuacgugucccagaucggcagcuuccccgaccagaccgaggacggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggccgacugccugcacgagaaguacggcgggcucaacaagagcaagccguacuacacgggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccacggcgucgccguggccgcggaccucaagagcacgcaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacaccaucagcucccagaucgagcuggccgugcugcucagcaacgagggcaucaucaacuccgaggacgagcaccuccuggcgcuggagcggaagcugaagaagaugcugggccccagcgccgucgagaucgggaacggcugcuucgagaccaagcacaagugcaaccagaccugccucgaccgcaucgccgccgggacguucaacgcgggcgaguucucccugcccaccuucgacagccugaacaucaccgccgccucccucaacgacgacgggcuggacaaccacaccauccugcuguacuacagcacggccgccuccagccucgcggugacccugaugcuggccaucuucaucguguacauggucucccgggacaacgugagcugcagcaucugccucuga

SEQ ID NO: 88776 - RNA, 1755 nt, Artificial Sequence; identical to SEQ ID NO: 88064
  derived and/or modified sequence opt1 from hemagglutinin__InfluenzaB__AGX24579

SEQ ID NO: 88777 - RNA, 1755 nt, Artificial Sequence; identical to SEQ ID NO: 88064
  derived and/or modified sequence opt1 from hemagglutinin__InfluenzaB__AGX24590

SEQ ID NO: 88778 - RNA, 1755 nt, Artificial Sequence; identical to SEQ ID NO: 88064
  derived and/or modified sequence opt1 from hemagglutinin__InfluenzaB__AGX24601

SEQ ID NO: 88779 - RNA, 1755 nt, Artificial Sequence; identical to SEQ ID NO: 88064
  derived and/or modified sequence opt1 from hemagglutinin__InfluenzaB__AGX24612

SEQ ID NO: 88780 - RNA, 1755 nt, Artificial Sequence; identical to SEQ ID NO: 87575
  derived and/or modified sequence opt1 from hemagglutinin__InfluenzaB__AGX24623

SEQ ID NO: 88781 - RNA, 1755 nt, Artificial Sequence; identical to SEQ ID NO: 88064
  derived and/or modified sequence opt1 from hemagglutinin__InfluenzaB__AGX24634

SEQ ID NO: 88782 - RNA, 1755 nt, Artificial Sequence; identical to SEQ ID NO: 88773
  derived and/or modified sequence opt1 from hemagglutinin__InfluenzaB__AGX24656

SEQ ID NO: 88783 - RNA, 1755 nt, Artificial Sequence; identical to SEQ ID NO: 87575
  derived and/or modified sequence opt1 from hemagglutinin__InfluenzaB__AGX24667

SEQ ID NO: 88784 - RNA, 1755 nt, Artificial Sequence; identical to SEQ ID NO: 87828
  derived and/or modified sequence opt1 from hemagglutinin__InfluenzaB__AGX24678

SEQ ID NO: 88785 - RNA, 1755 nt, Artificial Sequence; identical to SEQ ID NO: 88064
  derived and/or modified sequence opt1 from hemagglutinin__InfluenzaB__AGX24689

SEQ ID NO: 88786 - RNA, 1755 nt, Artificial Sequence; identical to SEQ ID NO: 88064
  derived and/or modified sequence opt1 from hemagglutinin__InfluenzaB__AGX24700

SEQ ID NO: 88787 - RNA, 1755 nt, Artificial Sequence; identical to SEQ ID NO: 88064
  derived and/or modified sequence opt1 from hemagglutinin__InfluenzaB__AGX24711

SEQ ID NO: 88788 - RNA, 1755 nt, Artificial Sequence; identical to SEQ ID NO: 87575
  derived and/or modified sequence opt1 from hemagglutinin__InfluenzaB__AGX24722

SEQ ID NO: 88789 - RNA, 1755 nt, Artificial Sequence; identical to SEQ ID NO: 87575
  derived and/or modified sequence opt1 from hemagglutinin__InfluenzaB__AGX24733

SEQ ID NO: 88790 - RNA, 1755 nt, Artificial Sequence; identical to SEQ ID NO: 87575
  derived and/or modified sequence opt1 from hemagglutinin__InfluenzaB__AGX24744

SEQ ID NO: 88791 - RNA, 1755 nt, Artificial Sequence; identical to SEQ ID NO: 87575
  derived and/or modified sequence opt1 from hemagglutinin__InfluenzaB__AGX24755

SEQ ID NO: 88792 - RNA, 1755 nt, Artificial Sequence; identical to SEQ ID NO: 88064
  derived and/or modified sequence opt1 from hemagglutinin__InfluenzaB__AGX24766

SEQ ID NO: 88793 - RNA, 1755 nt, Artificial Sequence; identical to SEQ ID NO: 87575
  derived and/or modified sequence opt1 from hemagglutinin__InfluenzaB__AGX24777

SEQ ID NO: 88794 - RNA, 1755 nt, Artificial Sequence; identical to SEQ ID NO: 87575
  derived and/or modified sequence opt1 from hemagglutinin__InfluenzaB__AGX24788

SEQ ID NO: 88795 - RNA, 1755 nt, Artificial Sequence; identical to SEQ ID NO: 87575
  derived and/or modified sequence opt1 from hemagglutinin__InfluenzaB__AGX24799

SEQ ID NO: 88796 - RNA, 1755 nt, Artificial Sequence; identical to SEQ ID NO: 88064
  derived and/or modified sequence opt1 from hemagglutinin__InfluenzaB__AGX24810

SEQ ID NO: 88797 - RNA, 1755 nt, Artificial Sequence; identical to SEQ ID NO: 88064
  derived and/or modified sequence opt1 from hemagglutinin__InfluenzaB__AGX24821

SEQ ID NO: 88798 - RNA, 1755 nt, Artificial Sequence
  derived and/or modified sequence opt1 from hemagglutinin__InfluenzaB__AGX24832
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgggggauccugcugccccagcgcgucuggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcgccuguccggggccauggacgagcuccacaacgagauccuggagcuggacgagaagguggacgaccuccgggccgacacgaucagcucccagaucgagcuggcggugcugcucagcaacgagggcaucaucaacuccgaggacgagcaccuccuggcccuggagcgcaagcugaagaagaugcugggccccagcgccgucgagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgcgacaacgugagcugcagcaucugccucuga

SEQ ID NO: 88799 - RNA, 1755 nt, Artificial Sequence
  derived and/or modified sequence opt1 from hemagglutinin__InfluenzaB__AGX24843
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacauggugcagaagcccgggaagacgggcaccaucgucuaccagcgcggggugcugcugccccagcgcguguggugcaccagcggccgguccaaggucaucaagggcagccucccccugaucggggaggccgacugccugcacgagaaguacggcgggcucaacaagagcaagccguacuacaccggcgagcacgcgaaggccaucgggaacugccccaucugggugaagacgccccugaagcuggccaacggcaccaaguaccggcccccggccaagcuccugaaggagcggggcuucuucggggccaucgcgggcuuccuggagggcgggugggaggggaugaucgccggcuggcacggcuacaccucccacggggcccacggcgucgccguggccgcggaccucaagagcacccaggaggccaucaacaagaucacgaagaaccugaacucccugagcgagcucgaggugaagaaccugcagcgccuguccggggccauggacgagcuccacaacgagauccuggagcuggacgagaaggucgacgaccuccgggccgacaccaucagcucccagaucgagcuggccgugcugcucagcaacgagggcaucaucaacuccgaggacgagcaccuccuggcgcuggagcgcaagcugaagaagaugcugggccccagcgccguggacaucgggaacggcugcuucgagaccaagcacaagugcaaccagaccugccucgaccggaucgccgccgggaccuucaacgcgggcgaguucucccugcccacguucgacagccugaacaucaccgccgccucccucaacgacgacgggcuggacaaccacaccauccugcuguacuacagcaccgccgccuccagccucgcggucacgcugaugcuggccaucuucaucguguacauggugucccgcgacaacgucagcugcuccaucugccucuga

SEQ ID NO: 88800 - RNA, 1755 nt, Artificial Sequence
  derived and/or modified sequence opt1 from hemagglutinin__InfluenzaB__AGX24854
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgagugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcgccgagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacauggugcagcggcccgggaagaccggcacgaucgucuaccagcgcggggugcugcugccccagaagguguggugcgcgagcggccgguccaaggucaucaagggcagccucccccugaucggggaggccgacugccugcacgagaaguacggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcgucgcgguggccgccgaccucaagagcacccaggaggccaucaacaagaucaccaagaaccugaacucccugagcgagcucgaggugaagaaccugcagcgccuguccggggccauggacgagcuccacaacgagauccuggagcuggacgagaaggucgacgaccuccgggcggacaccaucagcucccagaucgagcuggccgugcugcucagcaacgagggcaucaucaacuccgaggacgagcaccuccuggcccuggagcgcaagcugaagaagaugcugggccccagcgccguggacaucgggaacggcugcuucgagacgaagcacaagugcaaccagaccugccucgaccggaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgucacccugaugcuggccaucuucaucguguacauggugucccgcgacaacgucagcugcuccaucugccucuga

SEQ ID NO: 88801 - RNA, 1755 nt, Artificial Sequence
  derived and/or modified sequence opt1 from hemagglutinin__InfluenzaB__AGX24865
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcgccgagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacauggugcagcggcccgggaagaccggcacgaucgucuaccagcgcggggugcugcugccccagaagguguggugcgcgagcggccgguccaaggucaucaagggcagccucccccugaucggggaggccgacugccugcacgagaaguacggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcgucgcgguggccgccgaccucaagagcacccaggaggccaucaacaagaucaccaagaaccugaacucccugagcgagcucgaggugaagaaccugcagcgccuguccggggccauggacgagcuccacaacgagauccuggagcuggacgagaaggucgacgaccuccgggcggacaccaucagcucccagaucgagcuggccgugcugcucagcaacgagggcaucaucaacuccgaggacgagcaccuccuggcccuggagcgcaagcugaagaagaugcugggccccagcgccguggacaucgggaacggcugcuucgagacgaagcacaagugcaaccagaccugccucgaccggaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgucacccugaugcuggccaucuucaucguguacauggugucccgcgacaacgucagcugcuccaucugccucuga

SEQ ID NO: 88802 - RNA, 1755 nt, Artificial Sequence
  derived and/or modified sequence opt1 from hemagglutinin__InfluenzaB__AGX24876
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacagccugacgguggaggugccguacaucugcaaggagggcgaggaccagaucaccgucuggggguuccacuccgacaacaagccccagaugaagaaccuguacggcgacagcaacccccagaaguucaccuccagcgccaacggggugaccacgcacuacgugucccaggucggcgacuuccccgaccagaccgaggacggcgggcucccgcagagcggccgcaucgugguggacuacaugaugcagaagcccgggcggaccggcaccaucgucuaccagcgcggggugcugcugccccagaagguguggugcgccuccggccggagcaaggucaucaagggcagccucccccugaucggggaggcggacugccugcacgagaaguacggcgggcucaacaaguccaagccguacuacacgggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagacgugccucgaccggaucgccgcggggaccuucaacgccggcgaguucagccugcccaccuucgacucccugaacaucaccgccgccagccucaacgacgacgggcuggacaaccacaccauccugcuguacuacuccacggccgcgagcucccucgccgucacccugaugcuggccaucuucaucguguacauggugagccgcgacaacgucuccugcagcaucugccucuga

SEQ ID NO: 88803 - RNA, 1755 nt, Artificial Sequence
  derived and/or modified sequence opt1 from hemagglutinin__InfluenzaB__AGX24887
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgcgaccauggccugggccgugcccaaggacaacuacaagaacgccaccaacccgcagacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcugccgcaguccggccgcaucguggucgacuacauggugcagaagcccgggaagacgggcaccaucguguaccagcgcgggguccuccugccccagaagguguggugcgcgagcggccgguccaaggugaucaagggcagccugccccucaucggggaggccgacugccugcacgagaaguacggcgggcugaacaagagcaagccguacuacaccggcgagcacgccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgcggacacgaugagcucccagaucgagcucgccguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgcggccgggaccuucaacgccggcgaguucucccuccccaccuucgacagccugaacaucacggccgccucccugaacgacgacgggcucgacaaccacaccauccugcuguacuacagcaccgcggccuccagccuggccgugacccucaugcuggccaucuucaucgucuacauggugucccgggacaacgugagcugcuccaucugccuguga

SEQ ID NO: 88804 - RNA, 1755 nt, Artificial Sequence
  derived and/or modified sequence opt1 from hemagglutinin__InfluenzaB__AGX24898
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccggcggggaggaccagaucaccgucuggggcuuccacagcgacaacaagacccagaugaagucccuguacggggacagcaacccccagaaguucacguccagcgccaacggcgugaccacccacuacgugucccagaucggcgacuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88805 - RNA, 1758 nt, Artificial Sequence; identical to SEQ ID NO: 87691
  derived and/or modified sequence opt1 from hemagglutinin__InfluenzaB__AGX84854

SEQ ID NO: 88806 - RNA, 1758 nt, Artificial Sequence
  derived and/or modified sequence opt1 from hemagglutinin__InfluenzaB__AGX84865
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccccaacugcaccgaccuggacgucgcccuggggcgcccgaagugcaccggcaagauccccuccgcccgggugagcauccuccacgaggugcgccccgucacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgugacgaacggcaacggcuucuucgccaccauggccugggccgucccgaagaacgacaagaacaagaccgcgaccaacccccugacgaucgaggugcccuacaucugcaccgagggggaggaccagaucaccguguggggcuuccacuccgacaacgagacccagauggccaagcucuacggggacagcaagccccagaaguucacguccagcgccaacggcgucaccacccacuacgugucccagaucggcggguucccgaaccagaccgaggacggcgggcugccccagagcggccggaucguggucgacuacauggugcagaaguccgggaagacgggcaccaucaccuaccagcgcggcauccugcucccccagaagguguggugcgccagcgggcgguccaaggucaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcguggccgucgccgcggaccugaaguccacccaggaggccaucaacaagaucacgaagaaccugaacucccucagcgagcuggaggugaagaaccugcagcgccucuccggcgccauggacgagcugcacaacgagauccuggagcucgacgagaaggucgacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggucacgcugaugaucgccaucuucgugguguacauggucucccgcgacaacgugagcugcuccaucugccucuga

SEQ ID NO: 88807 - RNA, 1758 nt, Artificial Sequence; identical to SEQ ID NO: 88806
  derived and/or modified sequence opt1 from hemagglutinin__InfluenzaB__AGX84876

SEQ ID NO: 88808 - RNA, 1758 nt, Artificial Sequence; identical to SEQ ID NO: 88806
  derived and/or modified sequence opt1 from hemagglutinin__InfluenzaB__AGX84887

SEQ ID NO: 88809 - RNA, 1758 nt, Artificial Sequence; identical to SEQ ID NO: 87691
  derived and/or modified sequence opt1 from hemagglutinin__InfluenzaB__AGX84898

SEQ ID NO: 88810 - RNA, 1758 nt, Artificial Sequence
  derived and/or modified sequence opt1 from hemagglutinin__InfluenzaB__AGX84920
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgccggcgugagcauccuccacgagguccggcccgugacguccgggugcuuccccaucaugcacgaccgcaccaagauccggcagcugccgaaccugcuccgcggcuacgagcacauccggcugagcacccacaacgugaucaacgccgagaacgcgcccgggggccccuacaagaucgggaccuccggcagcugccccaacgucacgaacggcaacggguucuucgccaccauggccugggccgugccgaagaacgacaagaacaagaccgcgaccaacccccugacgaucgaggugcccuacaucugcaccgagggcgaggaccagaucaccgucuggggguuccacuccgacaacgagacccagauggccaagcucuacggcgacagcaagccccagaaguucacguccagcgccaacggcgugaccacccacuacgugucccagaucgggggcuucccgaaccagaccgaggacgggggccugccccagagcgggcgcaucgucguggacuacauggugcagaaguccggcaagacgggcaccaucaccuaccagcgggggauccugcucccccagaaggucuggugcgccagcggccgcuccaaggugaucaaggggagccugccccugaucggcgaggccgacugccuccacgagaaguacgggggccugaacaagagcaagccguacuacaccggcgagcacgcgaaggccaucgggaacugccccaucugggugaagacgccccugaagcucgccaacggcaccaaguaccggcccccggccaagcugcugaaggagcgcggguucuucggcgccaucgcgggguuccucgagggcggcugggaggggaugaucgccggcuggcacggguacaccucccacggcgcccacggcgucgccguggccgcggaccugaaguccacccaggaggccaucaacaagaucacgaagaaccugaacucccucagcgagcuggaggucaagaaccugcagcggcucuccggggccauggacgagcugcacaacgagauccuggagcucgacgagaagguggacgaccugcgcgccgacaccaucagcucccagaucgagcuggccgugcuccugagcaacgagggcaucaucaacuccgaggacgagcaccuccuggcgcuggagcggaagcugaagaagaugcucgggcccagcgccgucgagaucggcaacgggugcuucgagaccaagcacaagugcaaccagaccugccuggaccgcaucgccgccggcaccuucgacgcgggcgaguucucccugcccacguucgacagccucaacaucaccgccgccucccugaacgacgacgggcuggacaaccacaccauccuccuguacuacagcaccgccgccuccagccuggcggugacgcugaugaucgccaucuucguggucuacauggugucccgggacaacgugagcugcuccaucugccucuga

SEQ ID NO: 88811 - RNA, 1758 nt, Artificial Sequence
  derived and/or modified sequence opt1 from hemagglutinin__InfluenzaB__AGZ59821
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugcuucaacugcaccgaccuggacguggcccuggggcgccccaagugcaccggcaacaucccguccgccaaggugagcauccuccacgagguccggcccgugacguccggcugcuuccccaucaugcacgaccgcaccaaggugcggcagcugcccaaccugcuccgcggguacgagcacauccggcugagcacccacaacgucaucaacgccgagaaggcgccgggcgggcccuacaagaucggcaccuccgggagcugccccaacgugacgaacggcaacggcuucuucgccaccauggccugggccgugcccaagaacgacaacaacaagaccgcgaccaacucccugacgaucgaggucccguacaucugcaccgagggggaggaccagaucaccguguggggcuuccacagcgacaacgagacccagauggccaagcucuacggggacuccaagccccagaaguucacgagcuccgccaacggcgugaccacccacuacgucagccagaucggcggguuccccaaccagaccgaggacggcgggcugccccaguccggccgcaucgugguggacuacaugguccagaaguccgggaagacgggcaccaucaccuaccagcggggcauccugcucccgcagaagguguggugcgccuccgggcgcagcaaggugaucaagggcagccugccccugaucggggaggccgacugccuccacgagaaguacggcgggcugaacaaguccaagcccuacuacaccggcgagcacgcgaaggccaucggcaacugccccaucugggucaagacgccgcugaagcucgccaacgggaccaaguaccggccgcccgccaagcugcugaaggagcgcggcuucuucggggccaucgcgggcuuccucgagggcgggugggagggcaugaucgccggguggcacggcuacaccagccacggggcccacggcguggccgucgccgcggaccugaaguccacccaggaggccaucaacaagaucacgaagaaccugaacagccucuccgagcuggaggugaagaaccugcagcggcucagcggcgccauggacgagcugcacaacgagauccuggagcucgacgagaagguggacgaccugcgcgccgacaccaucuccagccagaucgagcuggccguccuccuguccaacgaggggaucaucaacagcgaggacgagcaccuccuggcgcuggagcggaagcugaagaagaugcucggccccuccgccguggagaucgggaacggcugcuucgagaccaagcacaagugcaaccagaccugccuggaccgcaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucgucguguacauggugagccgggacaacgucuccugcagcaucugccucuga

SEQ ID NO: 88812 - RNA, 1758 nt, Artificial Sequence
  derived and/or modified sequence opt1 from hemagglutinin__InfluenzaB__AGZ59832
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccggcaagagcaaggugaucaaggggagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgaggacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88813 - RNA, 1758 nt, Artificial Sequence
  derived and/or modified sequence opt1 from hemagglutinin__InfluenzaB__AGZ59843
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucaucguguacauggucagccgcgacaacguguccugcagcaucugccuguga

SEQ ID NO: 88814 - RNA, 1758 nt, Artificial Sequence; identical to SEQ ID NO: 88160
  derived and/or modified sequence opt1 from hemagglutinin__InfluenzaB__AGZ59854

SEQ ID NO: 88815 - RNA, 1758 nt, Artificial Sequence; identical to SEQ ID NO: 87522
  derived and/or modified sequence opt1 from hemagglutinin__InfluenzaB__AGZ59865

SEQ ID NO: 88816 - RNA, 1758 nt, Artificial Sequence
  derived and/or modified sequence opt1 from hemagglutinin__InfluenzaB__AGZ59876
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcaccuccgggcggagcaaggugaucaagggcagccugccccucaucggggaggccgacugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacgcaggaggcgaucaacaagaucaccaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcccuggagcgcaagcucaagaagaugcugggccccuccgcggucgagaucgggaacggcugcuucgagaccaagcacaagugcaaccagaccugccuggaccggaucgccgccgggacguucgacgccggcgaguucagccuccccaccuucgacucccugaacaucaccgcggccagccugaacgacgacggccucgacaaccacaccauccugcuguacuacuccacggccgccagcucccuggccgugacccucaugaucgcgaucuucguggucuacauggugagccgcgacaacguguccugcagcaucugccuguga

SEQ ID NO: 88817 - RNA, 1755 nt, Artificial Sequence; identical to SEQ ID NO: 87575
  derived and/or modified sequence opt1 from hemagglutinin__InfluenzaB__AGZ59887

SEQ ID NO: 88818 - RNA, 1758 nt, Artificial Sequence; identical to SEQ ID NO: 87997
  derived and/or modified sequence opt1 from hemagglutinin__InfluenzaB__AGZ59898

SEQ ID NO: 88819 - RNA, 1758 nt, Artificial Sequence; identical to SEQ ID NO: 88363
  derived and/or modified sequence opt1 from hemagglutinin__InfluenzaB__AGZ59909

SEQ ID NO: 88820 - RNA, 1758 nt, Artificial Sequence; identical to SEQ ID NO: 87997
  derived and/or modified sequence opt1 from hemagglutinin__InfluenzaB__AGZ59920

SEQ ID NO: 88821 - RNA, 1758 nt, Artificial Sequence; identical to SEQ ID NO: 87997
  derived and/or modified sequence opt1 from hemagglutinin__InfluenzaB__AGZ59931

SEQ ID NO: 88822 - RNA, 1758 nt, Artificial Sequence; identical to SEQ ID NO: 87997
  derived and/or modified sequence opt1 from hemagglutinin__InfluenzaB__AGZ59942

SEQ ID NO: 88823 - RNA, 1758 nt, Artificial Sequence; identical to SEQ ID NO: 87997
  derived and/or modified sequence opt1 from hemagglutinin__InfluenzaB__AGZ59953

SEQ ID NO: 88824 - RNA, 1758 nt, Artificial Sequence
  derived and/or modified sequence opt1 from hemagglutinin__InfluenzaB__AGZ59965
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggguggucguggacuacaugaugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 88825 - RNA, 1758 nt, Artificial Sequence; identical to SEQ ID NO: 87997
  derived and/or modified sequence opt1 from hemagglutinin__InfluenzaB__AGZ59976

SEQ ID NO: 88826 - RNA, 1758 nt, Artificial Sequence; identical to SEQ ID NO: 87997
  derived and/or modified sequence opt1 from hemagglutinin__InfluenzaB__AGZ59987

SEQ ID NO: 88827 - RNA, 1758 nt, Artificial Sequence; identical to SEQ ID NO: 87997
  derived and/or modified sequence opt1 from hemagglutinin__InfluenzaB__AGZ59999

SEQ ID NO: 88828 - RNA, 1758 nt, Artificial Sequence; identical to SEQ ID NO: 87616
  derived and/or modified sequence opt1 from hemagglutinin__InfluenzaB__AGZ60010

SEQ ID NO: 88829 - RNA, 1758 nt, Artificial Sequence; identical to SEQ ID NO: 87616
  derived and/or modified sequence opt1 from hemagglutinin__InfluenzaB__AGZ60021

SEQ ID NO: 88830 - RNA, 1758 nt, Artificial Sequence; identical to SEQ ID NO: 87616
  derived and/or modified sequence opt1 from hemagglutinin__InfluenzaB__AGZ60033

SEQ ID NO: 88831 - RNA, 1755 nt, Artificial Sequence
  derived and/or modified sequence opt1 from hemagglutinin__InfluenzaB__AGZ60044
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaacgccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacgucugcaccgagggcgaggaccagaucaccguguggggguuccacuccgacaacaagacccagaugaagaaccuguacggcgacagcaacccccagaaguucacguccagcgccaacggggugaccacccacuacgucucccagaucggcggcuuccccgcccagaccgaggacgggggccucccgcagagcgggcgcaucgugguggacuacaugguccagaagccccggaagacgggcaccaucguguaccagcgcggggugcugcugccccagaaggucuggugcgcguccggccggagcaaggugaucaagggcagccucccccugaucggggaggccgacugccugcacgagaaguacggcgggcucaacaaguccaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcgguggccgccgaccucaaguccacccaggaggccaucaacaagaucaccaagaaccugaacagccuguccgagcucgaggucaagaaccugcagcgccugagcggggccauggacgagcuccacaacgagauccuggagcuggacgagaagguggacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgugacccugaugcuggccaucuucaucguguacauggucagccgcgacaacguguccugcagcaucugccucuga

SEQ ID NO: 88832 - RNA, 1755 nt, Artificial Sequence; identical to SEQ ID NO: 88034
  derived and/or modified sequence opt1 from hemagglutinin__InfluenzaB__AGZ60055

SEQ ID NO: 88833 - RNA, 1755 nt, Artificial Sequence
  derived and/or modified sequence opt1 from hemagglutinin__InfluenzaB__AGZ60066
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggcccucggcgggccguaccggcugggcacguccgggagcugccccaacgccaccuccaagagcggcuucuucgccaccauggcgugggccguccccaaggacaacaacaagaacgccaccaacccccugacgguggaggugccguacaucugcaccgagggcgaggaccagaucaccgucuggggguuccacuccgacaacaagacccagaugaagaaccucuacggcgacagcaacccccagaaguucacguccagcgccaacggggugaccacccacuacgugucccagaucggcggcuuccccgaccagaccgaggacgggggccugccccagagcgggcgcaucgucguggacuacauggugcagaagccgggcaagacggggaccaucgucuaccagcggggcgugcugcucccccagaagguguggugcgccuccggccgcagcaaggucaucaaggggagccugccccugaucggcgaggcggacugccuccacgagaaguacgggggccugaacaaguccaagcccuacuacaccggggagcacgccaaggccaucggcaacugcccgaucugggugaagacgccccugaagcucgccaacggcaccaaguaccggccgcccgccaagcugcugaaggagcgcggguucuucggcgcgaucgccggguuccucgagggcgggugggagggcaugaucgccggcuggcacggguacaccagccacggcgcccacggggucgccguggcggccgaccugaaguccacccaggaggccaucaacaagaucaccaagaaccugaacagccucuccgagcuggaggugaagaaccugcagcggcucagcggcgccauggacgagcugcacaacgagauccuggagcucgacgagaaggucgacgaccugcgcgccgacacgaucuccagccagaucgagcuggcggugcuccuguccaacgagggcaucaucaacagcgaggacgagcaccuccuggcccuggagcggaagcugaagaagaugcucgggcccuccgccguggacaucggcaacgggugcuucgagaccaagcacaagugcaaccagaccugccuggaccgcaucgccgcgggcaccuucaacgccggggaguucagccugcccaccuucgacucccucaacaucacggccgccagccugaacgacgacggccuggacaaccacaccauccugcucuacuacuccaccgccgcgagcucccuggccgucacccugaugcucgccaucuucaucguguacauggugagccgggacaacgucuccugcagcaucugccuguga

SEQ ID NO: 88834 - RNA, 1755 nt, Artificial Sequence
  derived and/or modified sequence opt1 from hemagglutinin__InfluenzaB__AGZ60077
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacgcggacccgcggcaagcucugccccgacugccugaacugcaccgaccuggacguggcccucgggucccccaugugcgugggcaccacgccgagcgccaaggccuccauccugcacgagguccggcccgugaccagcggcugcuuccccaucaugcacgaccgcaccaagauccggcagcuggcgaaccuccugcgcggguacgagaacauccggcuguccacccagaacgugaucgacgccgagaaggcccccggcgggccguaccgccucggcacgagcggguccugccccaacgccaccagcaaguccggcuucuucgcgaccauggccugggccguccccaaggacaacaacaagaacgccaccaacccccugacgguggaggugccguacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccccaguccgggcggaucgucguggacuacaugaugcagaaguccggcaagacggggaccaucguguaccagcgcggcguccugcugccgcagaagguguggugcgcgagcggccgguccaaggugaucaaggggagccucccccugaucggcgaggccgacugccugcacgagaaguacgggggccucaacaaguccaagcccuacuacaccggggagcacgccaaggccaucggcaacugccccaucugggucaagaccccgcugaagcuggccaacggcacgaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacuccgagauccuggagcuggacgagaagguggacgaccuccgggcggacacgaucagcucccagaucgagcuggccguccugcucagcaacgagggcaucaucaacuccgaggacgagcaccuccuggcccuggagcgcaagcugaagaagaugcuggggcccagcgccguggacaucggcaacgggugcuucgagaccaagcacaagugcaaccagaccugccucgaccggaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugagccgcgacaacguguccugcagcaucugccucuga

SEQ ID NO: 88835 - RNA, 1755 nt, Artificial Sequence; identical to SEQ ID NO: 87739
  derived and/or modified sequence opt1 from hemagglutinin__InfluenzaB__AGZ60088

SEQ ID NO: 88836 - RNA, 1755 nt, Artificial Sequence; identical to SEQ ID NO: 87434
  derived and/or modified sequence opt1 from hemagglutinin__InfluenzaB__AGZ60099

SEQ ID NO: 88837 - RNA, 1755 nt, Artificial Sequence
  derived and/or modified sequence opt1 from hemagglutinin__InfluenzaB__AGZ60131
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccaucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccgugcccaaggacaacaacaagaacgccaccaacccgcugacggucgaggugcccuacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcagcuuccccgaccagaccgaggacggcgggcucccgcaguccggccgcaucguggucgacuacaugaugcagaagcccgggaagacgggcaccaucguguaccagcgcggggugcugcugccccagaaggucuggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcagcaucugccucuga

SEQ ID NO: 88838 - RNA, 1755 nt, Artificial Sequence; identical to SEQ ID NO: 87739
  derived and/or modified sequence opt1 from hemagglutinin__InfluenzaB__AGZ60142

SEQ ID NO: 88839 - RNA, 1755 nt, Artificial Sequence; identical to SEQ ID NO: 87739
  derived and/or modified sequence opt1 from hemagglutinin__InfluenzaB__AGZ60160

SEQ ID NO: 88840 - RNA, 1755 nt, Artificial Sequence; identical to SEQ ID NO: 87828
  derived and/or modified sequence opt1 from hemagglutinin__InfluenzaB__AGZ60172

SEQ ID NO: 88841 - RNA, 1755 nt, Artificial Sequence; identical to SEQ ID NO: 87828
  derived and/or modified sequence opt1 from hemagglutinin__InfluenzaB__AGZ60183

SEQ ID NO: 88842 - RNA, 1755 nt, Artificial Sequence
  derived and/or modified sequence opt1 from hemagglutinin__InfluenzaB__AGZ60194
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagacggggaagaccggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagcccuacuacaccggcgagcacgccaaggccaucgggaacugcccgaucugggucaagacgccccugaagcuggccaacggcaccaaguaccggccgcccgccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucacgaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugcuggccaucuucaucgucuacauggugucccgggacaacgugagcugcuccaucugccucuga

SEQ ID NO: 88843 - RNA, 1755 nt, Artificial Sequence
  derived and/or modified sequence opt1 from hemagglutinin__InfluenzaB__AGZ60206
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaucaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcugaccguggaggugcccuacaucugcacggagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 88844 - RNA, 1755 nt, Artificial Sequence; identical to SEQ ID NO: 88773
  derived and/or modified sequence opt1 from hemagglutinin__InfluenzaB__AGZ60217

SEQ ID NO: 88845 - RNA, 1755 nt, Artificial Sequence
  derived and/or modified sequence opt1 from hemagglutinin__InfluenzaB__AGZ60268
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccaucgacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucguguacauggucagccgggacaacguguccugcagcaucugccucuga

SEQ ID NO: 88846 - RNA, 1755 nt, Artificial Sequence; identical to SEQ ID NO: 87862
  derived and/or modified sequence opt1 from hemagglutinin__InfluenzaB__AHE37993

SEQ ID NO: 88847 - RNA, 1755 nt, Artificial Sequence; identical to SEQ ID NO: 87907
  derived and/or modified sequence opt1 from hemagglutinin__InfluenzaB__AHE37994

SEQ ID NO: 88848 - RNA, 1755 nt, Artificial Sequence; identical to SEQ ID NO: 87862
  derived and/or modified sequence opt1 from hemagglutinin__InfluenzaB__AHE37995

SEQ ID NO: 88849 - RNA, 1755 nt, Artificial Sequence; identical to SEQ ID NO: 87862
  derived and/or modified sequence opt1 from hemagglutinin__InfluenzaB__AHE37996

SEQ ID NO: 88850 - RNA, 1755 nt, Artificial Sequence; identical to SEQ ID NO: 87907
  derived and/or modified sequence opt1 from hemagglutinin__InfluenzaB__AHE37997

SEQ ID NO: 88851 - RNA, 1755 nt, Artificial Sequence; identical to SEQ ID NO: 87907
  derived and/or modified sequence opt1 from hemagglutinin__InfluenzaB__AHE37998

SEQ ID NO: 88852 - RNA, 1755 nt, Artificial Sequence; identical to SEQ ID NO: 87907
  derived and/or modified sequence opt1 from hemagglutinin__InfluenzaB__AHE37999

SEQ ID NO: 88853 - RNA, 1755 nt, Artificial Sequence; identical to SEQ ID NO: 87862
  derived and/or modified sequence opt1 from hemagglutinin__InfluenzaB__AHE38000

SEQ ID NO: 88854 - RNA, 1755 nt, Artificial Sequence; identical to SEQ ID NO: 87862
  derived and/or modified sequence opt1 from hemagglutinin__InfluenzaB__AHE38001

SEQ ID NO: 88855 - RNA, 1755 nt, Artificial Sequence
  derived and/or modified sequence opt1 from hemagglutinin__InfluenzaB__AHE38002
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccaagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 88856 - RNA, 1755 nt, Artificial Sequence; identical to SEQ ID NO: 87862
  derived and/or modified sequence opt1 from hemagglutinin__InfluenzaB__AHE38003

SEQ ID NO: 88857 - RNA, 1755 nt, Artificial Sequence; identical to SEQ ID NO: 87862
  derived and/or modified sequence opt1 from hemagglutinin__InfluenzaB__AHE38004

SEQ ID NO: 88858 - RNA, 1755 nt, Artificial Sequence; identical to SEQ ID NO: 87862
  derived and/or modified sequence opt1 from hemagglutinin__InfluenzaB__AHE38005

SEQ ID NO: 88859 - RNA, 1755 nt, Artificial Sequence
  derived and/or modified sequence opt1 from hemagglutinin__InfluenzaB__AHE38006
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcgccaccccguccgccaaggcgagcauccugcacgagguccggcccgugacguccggcugcuuccccaucaugcacgaccgcaccaagauccggcagcuggccaaccuccugcgcggguacgagaacauccggcugagcacccagaacgugaucgacgccgagaaggcccccggcgggccguaccgccucggcaccuccgggagcugccccaacgcgacguccaagagcggcuucuucgccaccauggccugggccguccccaaggacaacaacaagaacgccaccaacccccugaccguggaggugccguacaucugcgcggagggcgaggaccagaucacggucuggggguuccacuccgacaacaagacccagaugaagaaccuguacggcgacagcaacccccagaaguucaccuccagcgccaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacgggguggccgucgccgccgaccucaaguccacccaggaggcgaucaacaagaucaccaagaaccugaacagccuguccgagcucgaggugaagaaccugcagcgccugagcggcgccguggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccguggacaucggcaacgggugcuucgagaccaagcacaagugcaaccagacgugccucgaccggaucgccgccggcaccuucaacgccggggaguucagccugcccaccuucgacucccugaacaucaccgcggccagccucaacgacgacggccuggacaaccacaccauccugcuguacuacuccacggccgccagcucccucgccgucacccugaugcuggcgaucuucaucguguacauggugagccgcgacaacgucuccugcagcaucugccucuga

SEQ ID NO: 88860 - RNA, 1755 nt, Artificial Sequence; identical to SEQ ID NO: 87862
  derived and/or modified sequence opt1 from hemagglutinin__InfluenzaB__AHE38007

SEQ ID NO: 88861 - RNA, 1755 nt, Artificial Sequence
  derived and/or modified sequence opt1 from hemagglutinin__InfluenzaB__AHE38008
augaaggccaucaucgcccugcucaugguggucaccagcaacgcggaccgcaucugcaccggcaucacguccagcaacagcccccacguggugaagaccgccacccagggggaggucaacgugaccggcgugaucccgcugacgaccacccccaccaaguccuacuucgccaaccugaaggggacgaagacccggggcaagcucugccccgacugccugaacugcaccgaccuggacgucgcccucgggcgccccaugugcgugggcaccacgccguccgccaaggcgagcauccugcacgaggugcggcccgucaccuccggcugcuuccccaucaugcacgaccgcaccaagauccggcagcuggccaaccuccugcgcggguacgagaacauccggcugagcacccagaacgugaucgacgccgagaaggcccccggcgggccguaccgccucggcacguccgggagcugccccaacgcgaccuccaagagcggcuucuucgccaccauggccugggccgugcccaaggacaacaacaagaacgccaccaacccccugacggucgaggugccguacaucugcgcggagggcgaggaccagaucgccguguggggguuccacuccgacaacaagacccagaugaagaaccuguacggcgacagcaacccccagaaguucaccuccagcgccaacggggucaccacgcacuacgugucccagaucggcggcuuccccgaccagaccgaggacgggggccucccccagagcgggcggaucguggucgacuacaugaugcagaagccgggcaagaccgggaccaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacacgggggagcacgcgaaggccaucggcaacugcccgaucugggugaagacgccccugaagcuggccaacggcaccaaguaccgcccgcccgccaagcuccugaaggagcggggguucuucggcgccaucgcgggguuccuggagggcgggugggagggcaugaucgccggcuggcacggguacaccagccacggcgcccacggggucgccguggccgcggaccucaaguccacccaggaggccaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagacgugccucgaccggaucgccgccggcaccuucaacgcgggggaguucagccugcccaccuucgacucccugaacaucaccgccgccagccucaacgacgacggccuggacaaccacaccauccugcuguacuacuccacggccgccagcucccucgcggugacccugaugcuggccaucuucaucguguacauggucagccgcgacaacguguccugcagcaucugccucuga

SEQ ID NO: 88862 - RNA, 1755 nt, Artificial Sequence; identical to SEQ ID NO: 87907
  derived and/or modified sequence opt1 from hemagglutinin__InfluenzaB__AHE38009

SEQ ID NO: 88863 - RNA, 1755 nt, Artificial Sequence; identical to SEQ ID NO: 87907
  derived and/or modified sequence opt1 from hemagglutinin__InfluenzaB__AHE38010

SEQ ID NO: 88864 - RNA, 1755 nt, Artificial Sequence; identical to SEQ ID NO: 87862
  derived and/or modified sequence opt1 from hemagglutinin__InfluenzaB__AHE38012

SEQ ID NO: 88865 - RNA, 1755 nt, Artificial Sequence
  derived and/or modified sequence opt1 from hemagglutinin__InfluenzaB__AHE38013
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcguguccggccggagcaaggucaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggauggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagacgaagcacaagugcaaccagaccugccucgaccggaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgugacccugaugcuggccaucuucaucgucuacauggugagccgcgacaacguguccugcagcaucugccucuga

SEQ ID NO: 88866 - RNA, 1755 nt, Artificial Sequence; identical to SEQ ID NO: 87862
  derived and/or modified sequence opt1 from hemagglutinin__InfluenzaB__AHE38014

SEQ ID NO: 88867 - RNA, 1758 nt, Artificial Sequence; identical to SEQ ID NO: 87653
  derived and/or modified sequence opt1 from hemagglutinin__InfluenzaB__AHE38015

SEQ ID NO: 88868 - RNA, 1758 nt, Artificial Sequence
  derived and/or modified sequence opt1 from hemagglutinin__InfluenzaB__AHE38016
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggaaguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaucauccugcuguacuacagcaccgccgccuccagccuggcggugacccucaugaucgccaucuucguggucuacauggugucccgggacaacgugagcugcuccaucugccuguga

SEQ ID NO: 88869 - RNA, 1758 nt, Artificial Sequence; identical to SEQ ID NO: 87972
  derived and/or modified sequence opt1 from hemagglutinin__InfluenzaB__AHE38017

SEQ ID NO: 88870 - RNA, 1758 nt, Artificial Sequence; identical to SEQ ID NO: 87895
  derived and/or modified sequence opt1 from hemagglutinin__InfluenzaB__AHE38018

SEQ ID NO: 88871 - RNA, 1758 nt, Artificial Sequence; identical to SEQ ID NO: 87880
  derived and/or modified sequence opt1 from hemagglutinin__InfluenzaB__AHE38019

SEQ ID NO: 88872 - RNA, 1758 nt, Artificial Sequence
  derived and/or modified sequence opt1 from hemagglutinin__InfluenzaB__AHE38020
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaucacccccaccaagagccacuucgccaaccugaaggggaccgagacgcggggcaagcucugccccaagugccugaacugcaccgaccuggacguggcccucgggcgccccaagugcaccggcaagaucccguccgcccgggugagcauccugcacgagguccgccccgugaccuccggcugcuuccccaucaugcacgaccggacgaagauccgccagcugcccaaccuccugcggggguacgagcacauccgccugagcacccacaacgugaucaacgccgaggacgcgccgggcgggcccuacaagaucggcaccuccgggagcugccccaacgucaccaacggcaacggcuucuucgccacgauggccugggccgugcccaagaacgacaagaacaagaccgcgaccaacccgcucaccaucgaggugcccuacaucugcacggagggggaggaccagaucaccgucuggggcuuccacuccgacaacgagacccagauggccaagcuguacggggacagcaagccccagaaguucaccuccagcgccaacggcgugacgacccacuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcuccaucugccuguga

SEQ ID NO: 88873 - RNA, 1758 nt, Artificial Sequence
  derived and/or modified sequence opt1 from hemagglutinin__InfluenzaB__AHE38021
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 88874 - RNA, 1758 nt, Artificial Sequence; identical to SEQ ID NO: 87895
  derived and/or modified sequence opt1 from hemagglutinin__InfluenzaB__AHE38022

SEQ ID NO: 88875 - RNA, 1752 nt, Artificial Sequence
  derived and/or modified sequence opt1 from hemagglutinin__InfluenzaB__AHL91189
augaaggccaucaucgugcugcucauggucgccaccagcaacgcggaccgcaucugcaccggcaucacguccagcaacagcccccacguggugaagaccgccacccagggggaggucaacgugaccggcgugaucucccugacgaccaccccgaccaagucccacuucgccaaccugaaggggacgaagacccggggcaagcucugccccaacugccugaacugcaccgaccuggacgucgcccucgggcgccccaucugcaucggcaccauccccagcgccaaggcguccauccugcacgaggugcggccggugacgagcggcugcuuccccaucaugcacgaccgcaccaagauccggcagcugcccaaccuccugcgcggguacgagcacauccggcuguccacccacaacgucaucaacgccgagcgcgcccccggcgggccguaccggcucggcaccagcggguccugccccaacgugacgagccgcuccggcuucuucgccaccauggcgugggccgugccccgggacaacaagaccgccaccaacccccugacggucgaggugccguacaucugcaccaagggcgaggaccagaucaccguguggggguuccacagcgacaacaagacccagaugaagaaccuguacggcgacuccaacccccagaaguucacgagcuccgccaacggggucaccacccacuacgugagccagaucggcggcuuccccaaccagaccgaggacgggggccucccccaguccgggcgcaucguggucgacuacauggugcagaagccgggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugaucgccaucuucaucgucuacauggugucccgggacaacgugagcugcagcaucugccuguga

SEQ ID NO: 88876 - RNA, 1752 nt, Artificial Sequence
  derived and/or modified sequence opt1 from hemagglutinin__InfluenzaB__AHL91200
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacaacaagacccagaugaagaaccuguacggcgacagcaacccccagaaguucacguccagcgccaacggggugaccacccacuacgugucccagaucggcgacuuccccaaccagaccgaggacggcgggcucccgcagagcggccgcaucgucguggacuacauggugcagaagcccgggaagacgggcaccaucgucuaccagcgcggggugcugcugccccagaagguguggugcgccuccggccggagcaaggucaucaagggcagccucccccugaucggggaggccgacugccugcacgagaaguacggcgggcucaacaaguccaagccguacuacaccggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccagccacggggcccacggcgucgccguggccgcggaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgccgacacgaucuccagccagaucgagcuggccgugcugcucuccaacgagggcaucaucaacagcgaggacgagcaccuccuggcgcuggagcggaagcugaagaagaugcugggccccuccgccguggacaucgggaacggcugcuucgagaccaagcacaagugcaaccagaccugccucgaccgcaucgccgccgggaccuucaacgcgggcgaguucagccugcccaccuucgacucccugaacaucacggccgccagccucaacgacgacgggcuggacaaccacaccauccugcuguacuacuccaccgccgccagcucccucgcggucacccugaugaucgccaucuucaucguguacauggugagccgggacaacgucuccugcagcaucugccuguga

SEQ ID NO: 88877 - RNA, 1752 nt, Artificial Sequence
  derived and/or modified sequence opt1 from hemagglutinin__InfluenzaB__AHL91211
augaaggccaucaucgugcugcucauggucgccaccagcaacgcggaccgcaucugcaccggcaucacguccagcaacagcccccacguggugaagaccgccacccagggggaggucaacgugaccggcgugaucucccugacgaccaccccgaccaagucccacuucgccaaccugaaggggacgaagacccggggcaagcucugccccaacugccugaacugcaccgaccuggacgucgcccucgggcgccccaugugcaucggcaccauccccagcgccaaggcguccauccugcacgaggugcggccggugacgagcggcugcuuccccaucaugcacgaccgcaccaagauccggcagcugcccaaccuccugcgcggguacgagcacauccggcuguccacccacaacgucaucaacgccgagcgcgcccccggcgggccguaccggcucggcaccagcggguccugccccaacgugacgagccgcuccggcuucuucgccaccauggcgugggccgugccccgggacaacaagaccgccaccaacccccugacggucgaggugccguacaucugcaccaagggcgaggaccagaucaccguguggggguuccacagcgacaacaagacccagaugaagaaccuguacggcgacuccaacccccagaaguucacgagcuccgccaacggggucaccacccacuacgugagccagaucggcggcuuccccaaccagaccgaggacgggggccucccccaguccgggcgcaucguggucgacuacauggugcagaagccgggcaagacggggaccaucguguaccagcggggcguccugcugccccagaagguguggugcgccagcggccgcagcaaggugaucaaggggucccucccccugaucggcgaggcggacugccugcacgagaaguacgggggccucaacaagagcaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccucccacggcgcccacgggguggccgucgcggccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugaucgccaucuucaucgucuacauggugucccgggacaacgugagcugcagcaucugccuguga

SEQ ID NO: 88878 - RNA, 1755 nt, Artificial Sequence
  derived and/or modified sequence opt1 from hemagglutinin__InfluenzaB__AHL91222
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcugcccaaccuccugcgcggguacgagaacauccggcugagcacccagaacgugaucaacgcggagaaggccccgggcgggcccuaccgccucggcacguccgggagcugccccaacgccaccucccggagcggcuucuucgccaccauggcgugggccgucccccgcgacaacaacaagaccgccacgaacccgcugaccguggaggugcccuacgucugcaccgagggcgaggaccagaucaccguguggggguuccacuccgacaacaagacgcagaugaagaaccuguacggcgacagcaacccccagaaguucaccuccagcgccaacggggugaccacccacuacgucucccagaucggcggcuuccccgaccagacggaggacgggggccucccgcagagcgggcggaucgugguggacuacaugguccagaagcccggcaagaccgggaccaucguguaccagcgcggcgugcugcugccccagaaggucuggugcgccuccggccggagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucacgaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggcggugcugcucuccaacgagggcaucaucaacagcgaggacgagcaccuccuggcccuggagcgcaagcugaagaagaugcuggggcccuccgccgucgacaucggcaacgggugcuucgagaccaagcacaagugcaaccagaccugccucgaccggaucgccgcgggcaccuucaacgccggggaguucagccugcccacguucgacucccugaacaucaccgccgccagccucaacgacgacggccuggacaaccacaccauccugcuguacuacuccaccgccgcgagcucccucgccgugacgcugaugaucgccaucuucaucguguacauggucagccgcgacaacaucuccugcagcaucugccuguga

SEQ ID NO: 88879 - RNA, 1755 nt, Artificial Sequence
  derived and/or modified sequence opt1 from hemagglutinin__InfluenzaB__AHL91244
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcacgacccccuccgccaaggccagcauccugcacgagguccggcccgugaccuccggcugcuuccccaucaugcacgaccgcaccaagauccggcagcugcccaaccuccugcgcggguacgagaagauccggcugagcacgcagaacgugaucaacgcggagaaggccccgggcgggcccuaccgccucggcaccuccgggagcugccccaacgccaccucccggagcggcuucuucgccaccauggcgugggccgucccccgcgacaacaacaagacggccaccaacccgcugaccguggaggugcccuacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccggaucgucguggacuacauggugcagaagcccgggaagaccggcaccaucgucuaccagcgcggggugcugcugccccagaagguguggugcgccuccggccggagcaaggucaucaagggcagccucccccugaucggggaggcggacugccugcacgagaaguacggcgggcucaacaaguccaagccguacuacacgggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggccgacaccaucuccagccagaucgagcuggcggugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgucacccugaugaucgccaucuucaucguguacauggugagccgcgacaacgucuccugcagcaucugccuguga

SEQ ID NO: 88880 - RNA, 1755 nt, Artificial Sequence; identical to SEQ ID NO: 87509
  derived and/or modified sequence opt1 from hemagglutinin__InfluenzaB__AHL91255

SEQ ID NO: 88881 - RNA, 1755 nt, Artificial Sequence; identical to SEQ ID NO: 87509
  derived and/or modified sequence opt1 from hemagglutinin__InfluenzaB__AHL91266

SEQ ID NO: 88882 - RNA, 1752 nt, Artificial Sequence
  derived and/or modified sequence opt1 from hemagglutinin__InfluenzaB__AHL91277
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaacugccugaacugcaccgaccuggacguggcccucgggcgccccaugugcaucggcaucaccccguccgccaaggccagcauccugcacgaggugcggcccgucacguccggcugcuuccccaucaugcacgaccgcaccaagauccggcagcugcccaaccuccugcgcggguacgagcacauccggcugagcacccacaacgugaucaacgcggagcgcgccccgggcgggcccuaccggcucggcaccuccgggagcugccccaacgugacgucccgcagcggcuucuucgccaccauggccugggcggucccccgggacaacaagaccgccaccaacccgcugacgguggaggugcccuacaucugcaccaagggcgaggaccagaucaccgucuggggguuccacuccgacaacaagacccagaugaagaaccuguacggcgacagcaacccccagaaguucacguccagcgccaacgggaucaccacccacuacgugucccagaucggcggcuuccccaaccagaccgaggacgggggccucccgcagagcgggcgcaucguggucgacuacauggugcagaagcccggcaagacggggaccaucguguaccagcggggcguccugcugccccagaagguguggugcgccuccggccgcagcaaggugaucaaggggagccucccccugaucggcgaggccgacugccugcacgagaaguacgggggccucaacaaguccaagccguacuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagccacggcgcccacgggguggccgucgccgcggaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggccguccugcucuccaacgagggcaucaucaacagcgaggacgagcaccuccuggcgcuggagcggaagcugaagaagaugcuggggcccuccgccguggacaucggcaacgggugcuucgagaccaagcacaagugcaaccagaccugccucgaccgcaucgccgccggcaccuucaacgcgggggaguucagccugcccaccuucgacucccugaacaucacggccgccagccucaacgacgacggccuggacaaccacaccauccugcuguacuacuccaccgccgccagcucccucgcggugacccugaugaucgccaucuucaucgucuacauggugagccgggacaacguguccugcagcaucugccuguga

SEQ ID NO: 88883 - RNA, 1755 nt, Artificial Sequence
  derived and/or modified sequence opt1 from hemagglutinin__InfluenzaB__AHL91299
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccacccggucccacuucgccaaccugaaggggacgaagacccgcggcaagcucugcccgaccugccugaacugcaccgaccuggacguggcccucgggcggcccaugugcgugggcacgacccccuccgccaaggccagcauccugcacgagguccgccccgugaccuccggcugcuuccccaucaugcacgaccggaccaagauccgccagcugcccaaccuccugcggggguacgagaagauccgccugagcacgcagaacgugaucaacgcggagaaggccccgggcgggcccuaccggcucggcaccuccgggagcugccccaacgccaccucccgcagcggcuucuucgccaccauggcgugggccgucccccgggacaacaacaagacggccaccaacccgcugaccguggaggugcccuacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagccucccccugaucggggaggcggacugccugcacgagaaguacggcgggcucaacaaguccaagccguacuacacgggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgugacccugaugaucgccaucuucaucgucuacaugaucagccgggacaacguguccugcagcaucugccuguga

SEQ ID NO: 88884 - RNA, 1755 nt, Artificial Sequence
  derived and/or modified sequence opt1 from hemagglutinin__InfluenzaB__AHL91310
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcacgacccccuccgccaaggccagcauccugcacgagguccggcccgugaccuccggcugcuuccccaucaugcacgaccgcaccaagauccggcagcugcccaaccuccugcgcggguacgagaagauccggcugagcacgcagaacgugaucaacgcggagaaggccccgggcgggcccuaccgccucggcaccuccgggagcugccccaacgccaccucccggagcggcuucuucgccaccauggcgugggccgucccccgcgacaacaacaagacggccaccaacccgcugaccguggaggugcccuacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguacggcgggcucaacaaguccaagccguacuacacgggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaagguggacgaccuccgggccgacaccaucuccagccagaucgagcuggcgguccugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgugacccugaugaucgccaucuucaucgucuacaugaucagccgcgacaacguguccugcagcaucugccuguga

SEQ ID NO: 88885 - RNA, 1755 nt, Artificial Sequence
  derived and/or modified sequence opt1 from hemagglutinin__InfluenzaB__AHL91321
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugcccgaccugccugaacugcaccgaccuggacguggcccucgggcgccccaugugcgugggcacgacccccuccgccaaggccagcauccugcacgagguccggcccgugaccuccggcugcuuccccaucaugcacgaccgcaccaagauccggcagcugcccaaccuccugcgcggguacgagaagauccggcugagcacgcagaacgugaucaacgcggagaaggccccgggcgggcccuaccgccucggcaccuccgggagcugccccaacgccaccucccggagcggcuucuucgccaccauggcgugggccgucccccgcgacaacaacaagacggccaccaacccgcugaccguggaggugcccuacaucugcaccaaggaggaggaccagaucacggucuggggcuuccacuccgacaacaagacccagaugaagaaccuguacggggacagcaacccccagaaguucaccuccagcgccaacggcgugaccacgcacuacgugucccagaucgggggcuuccccgaccagaccgaggacggcgggcucccgcagagcggccggaucgucguggacuacauggugcagaagcccgggaagaccggcaccaucgucuaccagcgcggggugcugcugccccagaagguguggugcgccuccggccggagcaaggucaucaagggcagccucccccugaucggggaggcggacugccugcacgagaaguacggcgggcucaacaaguccaagccguacuacacgggcgagcacgccaaggccaucgggaacugccccaucugggugaagacgccccugaagcuggccaacggcaccaaguaccggcccccggccaagcuccugaaggagaagggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgcgccgacaccaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggacguucaacgccggcgaguucagccugcccaccuucgacucccugaacaucaccgccgccagccucaacgacgacgggcuggacaaccacaccauccugcuguacuacuccacggccgcgagcucccucgccgucacccugaugaucgccaucuucaucguguacauggugagccgggacaacgucuccugcagcaucugccuguga

SEQ ID NO: 88886 - RNA, 1755 nt, Artificial Sequence; identical to SEQ ID NO: 88884
  derived and/or modified sequence opt1 from hemagglutinin__InfluenzaB__AHL91332

SEQ ID NO: 88887 - RNA, 1755 nt, Artificial Sequence; identical to SEQ ID NO: 88884
  derived and/or modified sequence opt1 from hemagglutinin__InfluenzaB__AHL91343

SEQ ID NO: 88888 - RNA, 1755 nt, Artificial Sequence; identical to SEQ ID NO: 88884
  derived and/or modified sequence opt1 from hemagglutinin__InfluenzaB__AHL91354

SEQ ID NO: 88889 - RNA, 1755 nt, Artificial Sequence; identical to SEQ ID NO: 87487
  derived and/or modified sequence opt1 from hemagglutinin__InfluenzaB__AHL91365

SEQ ID NO: 88890 - RNA, 1755 nt, Artificial Sequence
  derived and/or modified sequence opt1 from hemagglutinin__InfluenzaB__AHL91376
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacggccacccccaccaagucccacuucgccaaccugaaggggaccaagacgcggggcaagcucugcccgaccugccugaacugcaccgaccuggacguggcccucgggcgccccaugugcgugggcgucacccccuccgccaaggcgagcauccugcacgaggugcggcccgugacguccggcugcuuccccaucaugcacgaccgcaccaagauccggcagcugcccaaccuccugcgcggguacgagaagauccggcugagcacccagaacgucaucaacgccgagaaggccccgggcgggcccuaccgccucggcaccuccgggagcugccccaacgccacgucccggagcggcuucuucgcgaccauggccugggccgugccccgcgacaacaacaagaccgccaccaacccgcugacgguggaggucccccacaucugcaccaaggaggaggaccagaucaccguguggggcuuccacuccgacaacaagacccagaugaagaaccuguacggggacagcaacccccagaaguucacguccagcgccaacggcgugaccacccacuacgucucccagaucgggggcuuccccgaccagaccgaggacggcgggcucccgcagagcggccggaucgugguggacuacaugguccagaagcccgggaagacgggcaccaucguguaccagcgcgggauccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcgucgcgguggccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugaucgccaucuucaucguguacaugaucagccgcgacaacguguccugcagcaucugccuguga

SEQ ID NO: 88891 - RNA, 1755 nt, Artificial Sequence
  derived and/or modified sequence opt1 from hemagglutinin__InfluenzaB__AHL91387
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgccaagucccacuucgccaaccugaaggggaccaagacgcggggcaagcucugcccgaccugccugaacugcaccgaccuggacguggcccucgggcgccccaugugcgugggcgucacccccuccgccaaggcgagcauccugcacgaggugcggcccgugacguccggcugcuuccccaucaugcacgaccgcaccaagauccggcagcugcccaaccuccugcgcggguacgagaagauccggcugagcacccagaacgucaucaacgccgagaaggccccgggcgggcccuaccgccucggcaccuccgggagcugccccaacgccacgucccggagcggcuucuucgcgaccauggccugggccgugccccgcgacaacaacaagaccgccaccaacccgcugacgguggaggucccccacaucugcaccaaggaggaggaccagaucaccguguggggcuuccacuccgacaacaagacccagaugaagaaccuguacggggacagcaacccccagaaguucacguccagcgccaacggcgugaccacccacuacgucucccagaucgggggcuuccccgaccagaccgaggacggcgggcucccgcagagcggccggaucgugguggacuacaugguccagaagcccgggaagacgggcaccaucguguaccagcgcgggauccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcgucgcgguggccgccgaccucaaguccacccaggaggccaucaacaagaucaccaagaaccugaacagccuguccgagcucgaggugaagaaccugcagcgccugagcggggccauggacgagcuccacaacgagauccuggagcuggacgagaaggucgacgaccuccgggcggacacgaucuccagccagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcacaagugcaaccagaccugccucgaccggaucgcggccgggaccuucaacgccggcgaguucagccugcccaccuucgacucccugaacaucacggccgccagccucaacgacgacgggcuggacaaccacaccauccugcuguacuacuccaccgcggccagcucccucgccgucacccugaugaucgccaucuucaucguguacaugaucagccgcgacaacguguccugcagcaucugccuguga

SEQ ID NO: 88892 - RNA, 1755 nt, Artificial Sequence
  derived and/or modified sequence opt1 from hemagglutinin__InfluenzaB__AHL91409
augaaggccaucaucgugcugcucauggucgugaccagcaacgccgaccgcaucugcaccggcaucacguccagcgacagcccccacguggucaagaccgcgacccagggggaggugaacgugaccggcgccaucccgcugacgaccacccccaccaaguccuacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccucccggagcggcuucuucgcgaccauggccugggccgugccccgcgacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccggaucgugguggacuacaugguccagaagcccgggaagaccggcaccaucguguaccagcgcgggauccugcugccccagaagguguggugcgcguccggccggagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugguggccggcuggcacggcuacaccagccacggggcccacggcgucgcgguggccgccgaccucaaguccacccaggaggccaucaacaagaucacgaagaaccugaacagccuguccgagcucgaggucaagaaccugcagcgccugagcggggccauggacgagcuccacaacgagauccuggagcuggacgagaagguggacgaccuccgggcggacaccaucuccagccagaucgagcuggccgugcugcucuccaacgagggcaucaucaacagcgaggacgagcaccuccuggcccuggagcgcaagcugaagaagaugcugggccccuccgccgucgacaucgggaacggcugcuucgagaccaagcacaagugcaaccagaccugccucgaccggaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgugacgcugaugaucgccaucuucaucguguacaugaucagccgcgacaacgucuccugcagcaucugccuguga

SEQ ID NO: 88893 - RNA, 1755 nt, Artificial Sequence
  derived and/or modified sequence opt1 from hemagglutinin__InfluenzaB__AHL91431
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacuuccugagcgagcucgaggugaagaaccugcagcggcuguccggggccauggacgagcuccacaacgagauccuggagcuggacgagaaggucgacgaccuccgcgcggacaccaucagcucccagaucgagcuggccgugcugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgcggccgggaccuucaacgccggcgaguucucccugcccacguucgacagccugaacaucaccgccgccucccucaacgacgacgggcuggacaaccacaccauccugcuguacuacagcaccgcggccuccagccucgccgucacgcugaugaucgccaucuucaucguguacaugaucucccgggacaacgugagcugcuccaucugccuguga

SEQ ID NO: 88894 - RNA, 1755 nt, Artificial Sequence
  derived and/or modified sequence opt1 from hemagglutinin__InfluenzaB__AHL91442
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagacggccccgggcgggcccuaccgccucggcaccuccgggagcugccccaacgccaccuccaagagcggcuucuucgcgaccauggccugggccgugccccgggacaacaacaagacggccaccaacccgcugaccgucgaggugccccacaucugcaccaaggaggaggaccagaucacgguguggggcuuccacuccgacaacaagacccagaugaagaaccuguacggggacagcaacccccagaaguucaccuccagcgccaacggcaucaccacgcacuacgucucccagaucgggggcuuccccgaccagaccgaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacacgggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggacguucaacgccggcgaguucagccugcccaccuucgacucccugaacaucaccgccgccagccucaacgacgacgggcuggacaaccacaccauccugcuguacuacuccacggcggccagcucccucgccgucacccugaugaucgccaucuucaucguguacaugaucagccgggacaacguguccugcagcaucugccuguga

SEQ ID NO: 88895 - RNA, 1755 nt, Artificial Sequence
  derived and/or modified sequence opt1 from hemagglutinin__InfluenzaB__AHL91453
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccaucgaggucccccacgugugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 88896 - RNA, 1755 nt, Artificial Sequence; identical to SEQ ID NO: 87413
  derived and/or modified sequence opt1 from hemagglutinin__InfluenzaB__AHL91464

SEQ ID NO: 88897 - RNA, 1755 nt, Artificial Sequence; identical to SEQ ID NO: 87519
  derived and/or modified sequence opt1 from hemagglutinin__InfluenzaB__AHL91475

SEQ ID NO: 88898 - RNA, 1755 nt, Artificial Sequence; identical to SEQ ID NO: 88894
  derived and/or modified sequence opt1 from hemagglutinin__InfluenzaB__AHL91486

SEQ ID NO: 88899 - RNA, 1755 nt, Artificial Sequence; identical to SEQ ID NO: 88894
  derived and/or modified sequence opt1 from hemagglutinin__InfluenzaB__AHL91497

SEQ ID NO: 88900 - RNA, 1755 nt, Artificial Sequence; identical to SEQ ID NO: 88894
  derived and/or modified sequence opt1 from hemagglutinin__InfluenzaB__AHL91530

SEQ ID NO: 88901 - RNA, 1755 nt, Artificial Sequence; identical to SEQ ID NO: 87413
  derived and/or modified sequence opt1 from hemagglutinin__InfluenzaB__AHL91541

SEQ ID NO: 88902 - RNA, 1755 nt, Artificial Sequence; identical to SEQ ID NO: 88894
  derived and/or modified sequence opt1 from hemagglutinin__InfluenzaB__AHL91552

SEQ ID NO: 88903 - RNA, 1755 nt, Artificial Sequence; identical to SEQ ID NO: 88894
  derived and/or modified sequence opt1 from hemagglutinin__InfluenzaB__AHL91574

SEQ ID NO: 88904 - RNA, 1755 nt, Artificial Sequence
  derived and/or modified sequence opt1 from hemagglutinin__InfluenzaB__AHL91585
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaugaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggaccuucaacgccggcgaguucagccugcccacguucgacucccugaacaucaccgccgccagccucaacgacgacgggcuggacaaccacaccauccugcuguacuacuccaccgcggccagcucccucgccgucacgcugaugaucgccaucuucaucguguacaugaucagccgggacaacguguccugcagcaucugccuguga

SEQ ID NO: 88905 - RNA, 1755 nt, Artificial Sequence
  derived and/or modified sequence opt1 from hemagglutinin__InfluenzaB__AHL91596
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacaccggcgagcacgccaaggccaucgggaacugccccaucugggugaagacgccccugaagcuggccaacggcaccaaguaccggcccccggcgaagauccucaaggagcgcggcuucuucggggccaucgccggcuuccuggagggcgggugggaggggaugaucgccggcuggcacggcuacaccagccacggggcccacggcguggcggucgccgccgaccugaaguccacccaggaggccaucaacaagaucacgaagaaccucaacagccuguccgagcuggaggugaagaaccuccagcggcugagcggggccauggacgagcugcacaacgagauccucgagcuggacgagaaggucgacgaccugcgcgcggacaccaucuccagccagaucgagcucgccgugcugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgcggccgggaccuucaacgccggcgaguucagccuccccacguucgacucccugaacaucaccgccgccagccugaacgacgacgggcucgacaaccacaccauccugcuguacuacuccaccgcggccagcucccuggccgucacgcucaugaucgccaucuucaucguguacaugaucagccgggacaacguguccugcagcaucugccuguga

SEQ ID NO: 88906 - RNA, 1755 nt, Artificial Sequence; identical to SEQ ID NO: 88905
  derived and/or modified sequence opt1 from hemagglutinin__InfluenzaB__AHL91607

SEQ ID NO: 88907 - RNA, 1755 nt, Artificial Sequence
  derived and/or modified sequence opt1 from hemagglutinin__InfluenzaB__AHL91618
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagacggccccgggcgggcccuaccgccucggcaccuccgggagcugccccaacgccaccuccaagagcggcuucuucgcgaccauggccugggccgugccccgggacaacaacaagacggccaccaacccgcugaccgucgaggugccccacaucugcaccaaggaggaggaccagaucacgguguggggcuuccacuccgacaacaagacccagaugaagaaccuguacggggacagcaacccccagaaguucaccuccagcgccaacggcaucaccacgcacuacgucucccagaucgggggcuuccccgaccagaccgaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacacgggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggacguucaacgucggcgaguucagccugcccaccuucgacucccugaacaucaccgccgccagccucaacgacgacgggcuggacaaccacaccauccugcuguacuacuccacggccgcgagcucccucgccgugacccugaugaucgccaucuucaucguguacaugaucagccgggacaacgucuccugcagcaucugccuguga

SEQ ID NO: 88908 - RNA, 1755 nt, Artificial Sequence
  derived and/or modified sequence opt1 from hemagglutinin__InfluenzaB__AHL91629
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugcuucaacugcaccgaccuggacgucgcccuggggcgccccaugugcgugggcaucacgcccuccgccaaggcgagcauccuccacgaggugcggcccgucaccuccggcugcuuccccaucaugcacgaccgcaccaagauccggcagcugcccaaccugcuccgcggguacgagaagauccggcugagcacccagaacgugaucgacgccgagaaggccccgggcgggcccuacaagcugggcacguccgggagcugccccaacgccaccuccaagagcggcuucuucgcgaccauggccugggccgugccccgcgacaacaacaagaccgccacgaacccgcucaccgucgaggugccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgucucccagaucgggggcuuccccgaccagacggaggacggcgggcugccgcagagcggccggaucgugguggacuacaugguccagaagcccgggaagaccggcaccaucguguaccagcgcgggauccuccugccccagaagguguggugcgcguccggccggagcaaggucaucaagggcagccugccccucaucggggaggccgacugccugcacgagaaguacggcgggcugaacaaguccaagccguacuacaccggcgagcacgccaaggccaucgggaacugccccaucugggugaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccagccacggggcccacggcguggcggucgccgccgaccugaaguccacccaggaggccaucaacaagaucacgaagaaccucaacagccuguccgagcuggaggugaagaaccuccagcgccugagcggggccauggacgagcugcacaacgagauccucgagcuggacgagaaggucgacgaccugcgggcggacaccaucuccagccagaucgagcucgccgugcugcuguccaacgagggcaucaucaacagcgaggacgagcaccuccuggcccuggagcgcaagcucaagaagaugcugggccccuccgccguggacaucgggaacggcugcuucgagaccaagcacaagugcaaccagaccugccuggaccggaucgcggccgggaccuucaacgccggcgaguucagccuccccacguucgacucccugaacaucaccgccgccagccugaacgacgacgggcucgacaaccacaccauccugcuguacuacuccaccgcggccagcucccuggccgucacgcucaugaucgccaucuucaucguguacaugaucagccgcgacaacguguccugcagcaucugccuguga

SEQ ID NO: 88909 - RNA, 1755 nt, Artificial Sequence; identical to SEQ ID NO: 88908
  derived and/or modified sequence opt1 from hemagglutinin__InfluenzaB__AHL91640

SEQ ID NO: 88910 - RNA, 1755 nt, Artificial Sequence; identical to SEQ ID NO: 87415
  derived and/or modified sequence opt1 from hemagglutinin__InfluenzaB__AHL91651

SEQ ID NO: 88911 - RNA, 1752 nt, Artificial Sequence
  derived and/or modified sequence opt1 from hemagglutinin__InfluenzaB__AHL91662
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagacggccccgggcgggcccuaccgccucggcaccuccgggagcugccccaacgccaccuccaagagcggcuucuucgcgaccauggccugggccgugccccgggacaacaacaagacggccaccaacccgcugaccgucgaggugccccacaucugcaccaaggaggaggaccagaucacgguguggggcuuccacuccgacaacaagacccagaugaagaaccuguacggggacagcaacccccagaaguucaccuccagcgccaacggcaucaccacgcacuacgucucccagaucgggggcuuccccgaccagaccgaggacggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcacgagaaguacggcgggcucaacaaguccaagccguacuacacgggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagccacggggcccacggcguggcggucgccgccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgcggccgggacguucaacgccggcgaguucagccugcccaccuucgacucccugaacaucaccgccgccagccucaacgacgggcuggacaaccacaccauccugcuguacuacuccacggcggccagcucccucgccgucacccugaugaucgccaucuucaucguguacaugaucagccgggacaacguguccugcagcaucugccuguga

SEQ ID NO: 88912 - RNA, 1755 nt, Artificial Sequence; identical to SEQ ID NO: 87519
  derived and/or modified sequence opt1 from hemagglutinin__InfluenzaB__AHL91673

SEQ ID NO: 88913 - RNA, 1755 nt, Artificial Sequence
  derived and/or modified sequence opt1 from hemagglutinin__InfluenzaB__AHL91684
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagucccacuucgccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaccgccucggcacguccgggagcugccccaacgccaccuccaagagcggcuucuucgcgaccauggccugggccgugccccgggacaacaacaagaccgccacgaacccgcugaccaucgaggucccccacaucugcaccaaggaggaggaccagaucaccguguggggcuuccacuccgacaacaagacgcagaugaagaaccuguacggggacagcaacccccagaaguucaccuccagcgccaacggcaucaccacccacuacgugucccagaucgggggcuuccccgaccagacggaggacggcgggcucccgcagagcggccgcaucgucguggacuacauggugcagaagcccgggaagaccggcaccaucgucuaccagcgggggauccugcugccccagaagguguggugcgcguccggccgcagcaaggugaucaagggcuuccucccccugaucggggaggccgacugccugcacgagaaguacggcgggcucaacaagagcaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcgguggccgccgaccucaagagcacccaggaggccaucaacaagaucacgaagaaccugaacucccugagcgagcucgaggucaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgcggccgggaccuucaacgccggcgaguucucccugcccacguucgacagccugaacaucaccgccgccucccucaacgacgacgggcuggacaaccacaccauccugcuguacuacagcaccgcggccuccagccucgccgugacgcugaugaucgccaucuucaucgucuacaugaucucccgggacaacgugagcugcuccaucugccuguga

SEQ ID NO: 88914 - RNA, 1755 nt, Artificial Sequence; identical to SEQ ID NO: 87415
  derived and/or modified sequence opt1 from hemagglutinin__InfluenzaB__AHL91695

SEQ ID NO: 88915 - RNA, 1755 nt, Artificial Sequence; identical to SEQ ID NO: 87519
  derived and/or modified sequence opt1 from hemagglutinin__InfluenzaB__AHL91706

SEQ ID NO: 88916 - RNA, 1758 nt, Artificial Sequence; identical to SEQ ID NO: 87987
  derived and/or modified sequence opt1 from hemagglutinin__InfluenzaB__AHL91717

SEQ ID NO: 88917 - RNA, 1758 nt, Artificial Sequence; identical to SEQ ID NO: 87987
  derived and/or modified sequence opt1 from hemagglutinin__InfluenzaB__AHL91728

SEQ ID NO: 88918 - RNA, 1758 nt, Artificial Sequence; identical to SEQ ID NO: 87987
  derived and/or modified sequence opt1 from hemagglutinin__InfluenzaB__AHL91739

SEQ ID NO: 88919 - RNA, 1755 nt, Artificial Sequence; identical to SEQ ID NO: 87519
  derived and/or modified sequence opt1 from hemagglutinin__InfluenzaB__AHL91750

SEQ ID NO: 88920 - RNA, 1758 nt, Artificial Sequence; identical to SEQ ID NO: 87987
  derived and/or modified sequence opt1 from hemagglutinin__InfluenzaB__AHL91761

SEQ ID NO: 88921 - RNA, 1758 nt, Artificial Sequence
  derived and/or modified sequence opt1 from hemagglutinin__InfluenzaB__AHL91772
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgggacaacguguccugcagcaucugccuguga

SEQ ID NO: 88922 - RNA, 1758 nt, Artificial Sequence; identical to SEQ ID NO: 88921
  derived and/or modified sequence opt1 from hemagglutinin__InfluenzaB__AHL91783

SEQ ID NO: 88923 - RNA, 1758 nt, Artificial Sequence; identical to SEQ ID NO: 88921
  derived and/or modified sequence opt1 from hemagglutinin__InfluenzaB__AHL91794

SEQ ID NO: 88924 - RNA, 1758 nt, Artificial Sequence
  derived and/or modified sequence opt1 from hemagglutinin__InfluenzaB__AHL91805
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugcuucaacugcaccgaccuggacguggcccuggggcgccccaagugcaccggcaacaucccguccgccgaggugagcauccuccacgagguccggcccgugacguccggcugcuuccccaucaugcacgaccgcaccaagauccggcagcugcccaaccugcuccgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacagcgacaacgagacccagauggccaagcucuacggggacuccaagccccagaaguucacgagcuccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccugcucccgcagaaggucuggugcgccuccgggcgcagcaaggugaucaagggcagccugccccugaucggggaggccgacugccuccacgagaaguacggcgggcugaacaaguccaagcccuacuacaccggcgagcacgcgaaggccaucggcaacugccccaucugggugaagacgccgcugaagcucgccaacgggaccaaguaccggccgcccgccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcggcucagcggcgccauggacgagcugcacaacgagauccuggagcucgacgagaagguggacgaccugcgcgccgacaccaucuccagccagaucgagcuggccgugcuccuguccaacgaggggaucaucaacagcgaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgggacaacguguccugcagcaucugccucuga

SEQ ID NO: 88925 - RNA, 1758 nt, Artificial Sequence; identical to SEQ ID NO: 87427
  derived and/or modified sequence opt1 from hemagglutinin__InfluenzaB__AHL91816

SEQ ID NO: 88926 - RNA, 1758 nt, Artificial Sequence; identical to SEQ ID NO: 87427
  derived and/or modified sequence opt1 from hemagglutinin__InfluenzaB__AHL91827

SEQ ID NO: 88927 - RNA, 1755 nt, Artificial Sequence; identical to SEQ ID NO: 88034
  derived and/or modified sequence opt1 from hemagglutinin__InfluenzaB__AHL91838

SEQ ID NO: 88928 - RNA, 1755 nt, Artificial Sequence
  derived and/or modified sequence opt1 from hemagglutinin__InfluenzaB__AHL91849
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgaggcgcgccccgucaccuccggcugcuuccccaucaugcacgaccggaccaagauccgccagcugcccaaccuccugcggggguacgagaacauccgccugagcacccagaacgugaucgacgccgagaacgccccgggcgggcccuaccggcucggcacguccgggagcugccccaacgccaccuccaagagcggcuucuucgcgaccauggccugggccgugcccaaggacaacaacaagaacgccaccaacccgcugacggucgaggugcccuacaucugcaaggagggcgaggaccagaucaccguguggggguuccacuccgacaacaagacccagaugaagaaccuguacggcgacagcaacccccagaaguucaccuccagcgccaacggggucacgacccacuacgugucccagaucagcggcuuccccgcgcagaccgaggacggcgggcucccgcaguccggccgcaucguggucgacuacauggugcagaagccccggaagaccgggacgaucguguaccagcgcggcguccugcugccccagaagguguggugcgccagcgggcggagcaaggugaucaagggcucccucccccugaucggcgaggccgacugccugcacgagaaguacgggggccucaacaagagcaagccguacuacaccggggagcacgccaaggccaucggcaacugccccaucugggucaagacgccccugaagcuggcgaacgggaccaaguaccggcccccggccaagcuccugaaggagcgcggcuucuucggcgccaucgccggguuccuggagggcgggugggagggcaugaucgccggguggcacggcuacaccucccacggcgcgcacgggguggccgucgccgccgaccucaagagcacccaggaggccaucaacaagaucaccaagaaccugaacucccugagcgagcucgaggugaagaaccugcagcgccuguccggcgcgauggacgagcuccacaacgagauccuggagcuggacgagaagguggacgaccuccgggccgacaccaucagcucccagaucgagcuggccguccugcucagcaacgaggggaucaucaacuccgaggacgagcaccuccuggcccuggagcgcaagcugaagaagaugcugggccccagcgcgguggacaucggcaacgggugcuucgagacgaagcacaagugcaaccagaccugccucgaccggaucgccgccggcaccuucaacgccggggaguucucccugcccaccuucgacagccugaacaucaccgccgcgucccucaacgacgacggccuggacaaccacacgauccugcuguacuacagcaccgccgccuccagccucgccgugacccugaugcuggccaucuucaucgucuacauggugucccgcgacaacgugagcugcagcaucugccucuga

SEQ ID NO: 88929 - RNA, 1755 nt, Artificial Sequence
  derived and/or modified sequence opt1 from hemagglutinin__InfluenzaB__AHL91860
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggagauccccuacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgaccagaccgaggacgggggccucccgcagagcgggcgcaucguggucgacuacaugaugcagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgagaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacgccauccugcuguacuacuccaccgcggccagcucccucgccgugacccugaugcuggccaucuucaucguguacauggucagccgggacaacguguccugcagcaucugccucuga

SEQ ID NO: 88930 - RNA, 1755 nt, Artificial Sequence
  derived and/or modified sequence opt1 from hemagglutinin__InfluenzaB__AHL91871
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggagauccccuacaucugcaccgagggcgaggaccagaucaccguguggggguuccacuccgacaacaagacccagaugaagaaccuguacggcgacagcaacccccagaaguucacguccagcgccaacggggucaccacccacuacgugucccagaucggcggcuuccccgaccagaccgaggacgggggccucccgcagagcgggcgcaucguggucgacuacaugaugcagaagcccggcaagacggggaccaucguguaccagcggggcgugcugcugccccagaaggucuggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgagaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucguguacauggucagccgggacaacguguccugcagcaucugccucuga

SEQ ID NO: 88931 - RNA, 1755 nt, Artificial Sequence; identical to SEQ ID NO: 87434
  derived and/or modified sequence opt1 from hemagglutinin__InfluenzaB__AHL91882

SEQ ID NO: 88932 - RNA, 1755 nt, Artificial Sequence
  derived and/or modified sequence opt1 from hemagglutinin__InfluenzaB__AHL91904
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccccagagcgggcgcaucgucguggacuacaugaugcagaagcacggcaagacggggaccaucguguaccagcggggcguccugcugccgcagaagguguggugcgcguccggccgcagcaaggugaucaaggggagccucccccugaucggcgaggccgacugccugcacgagaaguacgggggccucaacaaguccaagcccuacuacaccggggagcacgccaaggccaucggcaacugccccaucugggucaagaccccgcugaagcuggccaacggcacgaaguaccggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgcggacacgaucuccagccagaucgagcuggccguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgggacaacguguccugcagcaucugccucuga

SEQ ID NO: 88933 - RNA, 1755 nt, Artificial Sequence
  derived and/or modified sequence opt1 from hemagglutinin__InfluenzaB__AHL91915
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacuacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugccugcacgagaaguacgggggccucaacaaguccaagccguacuacaccggggagcacgccaaggccaucggcaacugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcuggggcccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 88934 - RNA, 1755 nt, Artificial Sequence; identical to SEQ ID NO: 88032
  derived and/or modified sequence opt1 from hemagglutinin__InfluenzaB__AHL91926

SEQ ID NO: 88935 - RNA, 1755 nt, Artificial Sequence; identical to SEQ ID NO: 88607
  derived and/or modified sequence opt1 from hemagglutinin__InfluenzaB__AHL91937

SEQ ID NO: 88936 - RNA, 1755 nt, Artificial Sequence; identical to SEQ ID NO: 87434
  derived and/or modified sequence opt1 from hemagglutinin__InfluenzaB__AHL91948

SEQ ID NO: 88937 - RNA, 1758 nt, Artificial Sequence
  derived and/or modified sequence opt1 from hemagglutinin__InfluenzaB__AHL91959
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagcuucaacgacgacggccuggacaaccacaccauccuccuguacuacuccaccgccgccagcucccuggcggucacgcugaugaucgccaucuucgugguguacauggucagccgggacaacguguccugcagcaucugccucuga

SEQ ID NO: 88938 - RNA, 1758 nt, Artificial Sequence; identical to SEQ ID NO: 87646
  derived and/or modified sequence opt1 from hemagglutinin__InfluenzaB__AHL91970

SEQ ID NO: 88939 - RNA, 1755 nt, Artificial Sequence
  derived and/or modified sequence opt1 from hemagglutinin__InfluenzaB__AHL91991
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguacgagaacauccgccugagcacccagaacgugaucgacgccgagaaggcccccggcgggccguaccggcucggcacguccgggagcugccccaacgccaccaacaaguccggcuucuucgcgaccauggccugggccguccccaaggacaacaacaagaacgccaccaacccccugacgguggaggugccguacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcggcuuccccgaccagaccgaggacgggggccucccccaguccgggcgcaucgucguggacuacaugaugcagaagccgggcaagacggggaccaucguguaccagcggggcguccugcugccccagaagguguggugcgcgagcggccgcuccaaggugaucaaggggagccucccccugaucggcgaggccgacugccugcacgagaaguacgggggccucaacaagagcaagcccuacuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccucccacggcgcccacgggguggcggucgccgccgaccucaagagcacccaggaggccaucaacaagaucaccaagaaccugaacucccugagcgagcucgaggugaagaaccugcagcggcuguccggcgccauggacgagcuccacaacgagauccuggagcuggacgagaagguggacgaccuccgcgcggacacgaucagcucccagaucgagcuggccguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgcggccggcaccuucaacgccggggaguucucccugcccaccuucgacagccugaacaucacggccgccucccucaacgacgacggccuggacaaccacaccauccugcuguacuacagcaccgcggccuccagccucgccgugacccugaugcuggccaucuucaucgucuacauggugucccgggacaacgugagcugcuccaucugccucuga

SEQ ID NO: 88940 - RNA, 1758 nt, Artificial Sequence; identical to SEQ ID NO: 87522
  derived and/or modified sequence opt1 from hemagglutinin__InfluenzaB__AHL92002

SEQ ID NO: 88941 - RNA, 1758 nt, Artificial Sequence; identical to SEQ ID NO: 87522
  derived and/or modified sequence opt1 from hemagglutinin__InfluenzaB__AHL92013

SEQ ID NO: 88942 - RNA, 1758 nt, Artificial Sequence; identical to SEQ ID NO: 87522
  derived and/or modified sequence opt1 from hemagglutinin__InfluenzaB__AHL92024

SEQ ID NO: 88943 - RNA, 1758 nt, Artificial Sequence; identical to SEQ ID NO: 87522
  derived and/or modified sequence opt1 from hemagglutinin__InfluenzaB__AHL92035

SEQ ID NO: 88944 - RNA, 1758 nt, Artificial Sequence; identical to SEQ ID NO: 87522
  derived and/or modified sequence opt1 from hemagglutinin__InfluenzaB__AHL92046

SEQ ID NO: 88945 - RNA, 1758 nt, Artificial Sequence; identical to SEQ ID NO: 87522
  derived and/or modified sequence opt1 from hemagglutinin__InfluenzaB__AHL92057

SEQ ID NO: 88946 - RNA, 1758 nt, Artificial Sequence
  derived and/or modified sequence opt1 from hemagglutinin__InfluenzaB__AHL92068
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccaggugggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 88947 - RNA, 1758 nt, Artificial Sequence
  derived and/or modified sequence opt1 from hemagglutinin__InfluenzaB__AHL92079
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 88948 - RNA, 1758 nt, Artificial Sequence; identical to SEQ ID NO: 88947
  derived and/or modified sequence opt1 from hemagglutinin__InfluenzaB__AHL92090

SEQ ID NO: 88949 - RNA, 1758 nt, Artificial Sequence; identical to SEQ ID NO: 87522
  derived and/or modified sequence opt1 from hemagglutinin__InfluenzaB__AHL92101

SEQ ID NO: 88950 - RNA, 1755 nt, Artificial Sequence; identical to SEQ ID NO: 87575
  derived and/or modified sequence opt1 from hemagglutinin__InfluenzaB__AHL92112

SEQ ID NO: 88951 - RNA, 1758 nt, Artificial Sequence; identical to SEQ ID NO: 87522
  derived and/or modified sequence opt1 from hemagglutinin__InfluenzaB__AHL92123

SEQ ID NO: 88952 - RNA, 1758 nt, Artificial Sequence; identical to SEQ ID NO: 88947
  derived and/or modified sequence opt1 from hemagglutinin__InfluenzaB__AHL92134

SEQ ID NO: 88953 - RNA, 1758 nt, Artificial Sequence; identical to SEQ ID NO: 88947
  derived and/or modified sequence opt1 from hemagglutinin__InfluenzaB__AHL92145

SEQ ID NO: 88954 - RNA, 1758 nt, Artificial Sequence; identical to SEQ ID NO: 87522
  derived and/or modified sequence opt1 from hemagglutinin__InfluenzaB__AHL92156

SEQ ID NO: 88955 - RNA, 1758 nt, Artificial Sequence; identical to SEQ ID NO: 88947
  derived and/or modified sequence opt1 from hemagglutinin__InfluenzaB__AHL92167

SEQ ID NO: 88956 - RNA, 1758 nt, Artificial Sequence; identical to SEQ ID NO: 87522
  derived and/or modified sequence opt1 from hemagglutinin__InfluenzaB__AHL92178

SEQ ID NO: 88957 - RNA, 1758 nt, Artificial Sequence; identical to SEQ ID NO: 87522
  derived and/or modified sequence opt1 from hemagglutinin__InfluenzaB__AHL92189

SEQ ID NO: 88958 - RNA, 1755 nt, Artificial Sequence; identical to SEQ ID NO: 87575
  derived and/or modified sequence opt1 from hemagglutinin__InfluenzaB__AHL92200

SEQ ID NO: 88959 - RNA, 1758 nt, Artificial Sequence; identical to SEQ ID NO: 87522
  derived and/or modified sequence opt1 from hemagglutinin__InfluenzaB__AHL92211

SEQ ID NO: 88960 - RNA, 1758 nt, Artificial Sequence; identical to SEQ ID NO: 87522
  derived and/or modified sequence opt1 from hemagglutinin__InfluenzaB__AHL92222

SEQ ID NO: 88961 - RNA, 1755 nt, Artificial Sequence; identical to SEQ ID NO: 88837
  derived and/or modified sequence opt1 from hemagglutinin__InfluenzaB__AHL92233

SEQ ID NO: 88962 - RNA, 1758 nt, Artificial Sequence; identical to SEQ ID NO: 88947
  derived and/or modified sequence opt1 from hemagglutinin__InfluenzaB__AHL92244

SEQ ID NO: 88963 - RNA, 1758 nt, Artificial Sequence; identical to SEQ ID NO: 87522
  derived and/or modified sequence opt1 from hemagglutinin__InfluenzaB__AHL92255

SEQ ID NO: 88964 - RNA, 1758 nt, Artificial Sequence; identical to SEQ ID NO: 87522
  derived and/or modified sequence opt1 from hemagglutinin__InfluenzaB__AHL92266

SEQ ID NO: 88965 - RNA, 1758 nt, Artificial Sequence
  derived and/or modified sequence opt1 from hemagglutinin__InfluenzaB__AHL92277
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccaccgggacguucgacgccggcgaguucagccuccccaccuucgacucccugaacaucaccgcggccagccugaacgacgacggccucgacaaccacaccauccugcuguacuacuccacggccgccagcucccuggccgugacccucaugaucgcgaucuucguggucuacauggugagccgcgacaacguguccugcagcaucugccuguga

SEQ ID NO: 88966 - RNA, 1758 nt, Artificial Sequence; identical to SEQ ID NO: 87522
  derived and/or modified sequence opt1 from hemagglutinin__InfluenzaB__AHL92288

SEQ ID NO: 88967 - RNA, 1758 nt, Artificial Sequence; identical to SEQ ID NO: 87522
  derived and/or modified sequence opt1 from hemagglutinin__InfluenzaB__AHL92299

SEQ ID NO: 88968 - RNA, 1755 nt, Artificial Sequence; identical to SEQ ID NO: 88640
  derived and/or modified sequence opt1 from hemagglutinin__InfluenzaB__AHL92310

SEQ ID NO: 88969 - RNA, 1755 nt, Artificial Sequence; identical to SEQ ID NO: 87575
  derived and/or modified sequence opt1 from hemagglutinin__InfluenzaB__AHL92321

SEQ ID NO: 88970 - RNA, 1755 nt, Artificial Sequence; identical to SEQ ID NO: 87575
  derived and/or modified sequence opt1 from hemagglutinin__InfluenzaB__AHL92332

SEQ ID NO: 88971 - RNA, 1755 nt, Artificial Sequence
  derived and/or modified sequence opt1 from hemagglutinin__InfluenzaB__AHL92354
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaucaccccguccgccaaggccagcauccugcacgagguccgccccgugacguccggcugcuuccccaucaugcacgaccggaccaagauccgccagcuggcgaaccuccugcggggguacgagaacauccgccugagcacccagaacguggucgacgccgagaaggcccccggcgggccguaccggcucggcaccuccgggagcugccccaacgccacguccaagagcggcuucuucgcgaccauggccugggccgugcccaaggacaacaacaagaacgccaccaacccccugaccguggaggucccguacaucugcacggagggcgaggaccagaucaccguguggggguuccacuccgacaacaagacccagaugaagaaccuguacggcgacagcaacccccagaaguucaccuccagcgccaacggggugacgacccacuacgucucccagaucggcggcuuccccgaccagaccgaggacgggggccucccccagagcgggcgcaucgugguggacuacaugaugcagaagccgggcaagaccgggacgaucgucuaccagcggggcgugcugcugccccagaagguguggugcgcguccggccgcagcaaggucaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagccacggcgcccacggggucgcgguggccgccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaaggucgacgaccuccgcgcggacaccaucuccagccagaucgagcuggccgugcugcucuccaacgagggcaucaucaacagcgaggacgagcaccuccuggcccuggagcggaagcugaagaagaugcuggggcccuccgccguggacaucggcaacgggugcuucgagacgaagcacaagugcaaccagaccugccucgaccgcaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgucacccugaugcuggccaucuucaucguguacauggugagccgggacaacgucuccugcagcaucugccucuga

SEQ ID NO: 88972 - RNA, 1755 nt, Artificial Sequence; identical to SEQ ID NO: 88971
  derived and/or modified sequence opt1 from hemagglutinin__InfluenzaB__AHL92365

SEQ ID NO: 88973 - RNA, 1755 nt, Artificial Sequence; identical to SEQ ID NO: 87828
  derived and/or modified sequence opt1 from hemagglutinin__InfluenzaB__AHL92376

SEQ ID NO: 88974 - RNA, 1755 nt, Artificial Sequence; identical to SEQ ID NO: 87828
  derived and/or modified sequence opt1 from hemagglutinin__InfluenzaB__AHL92387

SEQ ID NO: 88975 - RNA, 1755 nt, Artificial Sequence; identical to SEQ ID NO: 87828
  derived and/or modified sequence opt1 from hemagglutinin__InfluenzaB__AHL92398

SEQ ID NO: 88976 - RNA, 1755 nt, Artificial Sequence; identical to SEQ ID NO: 87828
  derived and/or modified sequence opt1 from hemagglutinin__InfluenzaB__AHL92409

SEQ ID NO: 88977 - RNA, 1755 nt, Artificial Sequence; identical to SEQ ID NO: 87828
  derived and/or modified sequence opt1 from hemagglutinin__InfluenzaB__AHL92420

SEQ ID NO: 88978 - RNA, 1755 nt, Artificial Sequence; identical to SEQ ID NO: 87575
  derived and/or modified sequence opt1 from hemagglutinin__InfluenzaB__AHL92431

SEQ ID NO: 88979 - RNA, 1755 nt, Artificial Sequence; identical to SEQ ID NO: 87828
  derived and/or modified sequence opt1 from hemagglutinin__InfluenzaB__AHL92442

SEQ ID NO: 88980 - RNA, 1755 nt, Artificial Sequence; identical to SEQ ID NO: 87828
  derived and/or modified sequence opt1 from hemagglutinin__InfluenzaB__AHL92453

SEQ ID NO: 88981 - RNA, 1755 nt, Artificial Sequence; identical to SEQ ID NO: 87828
  derived and/or modified sequence opt1 from hemagglutinin__InfluenzaB__AHL92464

SEQ ID NO: 88982 - RNA, 1755 nt, Artificial Sequence
  derived and/or modified sequence opt1 from hemagglutinin__InfluenzaB__AHL92475
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccaggccugccucgaccgcaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgugacccugaugcuggccaucuucaucgucuacauggugucccgggacaacgugagcugcuccaucugccucuga

SEQ ID NO: 88983 - RNA, 1755 nt, Artificial Sequence; identical to SEQ ID NO: 87575
  derived and/or modified sequence opt1 from hemagglutinin__InfluenzaB__AHL92486

SEQ ID NO: 88984 - RNA, 1755 nt, Artificial Sequence; identical to SEQ ID NO: 87828
  derived and/or modified sequence opt1 from hemagglutinin__InfluenzaB__AHL92497

SEQ ID NO: 88985 - RNA, 1755 nt, Artificial Sequence; identical to SEQ ID NO: 87828
  derived and/or modified sequence opt1 from hemagglutinin__InfluenzaB__AHL92508

SEQ ID NO: 88986 - RNA, 1755 nt, Artificial Sequence; identical to SEQ ID NO: 87828
  derived and/or modified sequence opt1 from hemagglutinin__InfluenzaB__AHL92519

SEQ ID NO: 88987 - RNA, 1755 nt, Artificial Sequence; identical to SEQ ID NO: 87828
  derived and/or modified sequence opt1 from hemagglutinin__InfluenzaB__AHL92530

SEQ ID NO: 88988 - RNA, 1755 nt, Artificial Sequence; identical to SEQ ID NO: 87575
  derived and/or modified sequence opt1 from hemagglutinin__InfluenzaB__AHL92541

SEQ ID NO: 88989 - RNA, 1752 nt, Artificial Sequence
  derived and/or modified sequence opt1 from hemagglutinin__InfluenzaB__AHL92563
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaagaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcugaccguggaggugcccuacaucugcacggagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 88990 - RNA, 1755 nt, Artificial Sequence; identical to SEQ ID NO: 87828
  derived and/or modified sequence opt1 from hemagglutinin__InfluenzaB__AHL92574

SEQ ID NO: 88991 - RNA, 1755 nt, Artificial Sequence
  derived and/or modified sequence opt1 from hemagglutinin__InfluenzaB__AHL92585
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcgccaccccguccgccaaggcgagcauccugcacgagguccgccccgugacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgccacguccaagagcggcuucuucgcgaccauggccugggccguccccaaggacaacaacaagaacgccaccaacccgcugaccguggaggugcccuacaucugcacggagggcgaggaccagaucaccgucuggggguuccacuccgacaacaagacccagaugaagaaccuguacggcgacagcaacccccagaaguucaccuccagcgccaacggggugacgacccacuacgugucccagaucggcagcuuccccgaccagaccgaggacggcgggcucccgcaguccggccgcaucgucguggacuacaugaugcagaagcccgggaagaccggcacgaucguguaccagcgcgggguccugcugccccagaagguguggugcgcgagcggccggagcaaggugaucaagggcucccucccccugaucggggaggccgacugccugcacgagaaguacggcgggcucaacaagagcaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggagaucgggaacggcugcuucgagacgaagcacaagugcaaccagaccugccucgaccgcaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgugacccugaugcuggccaucuucaucgucuacauggugucccgggacaacgugagcugcagcaucugccucuga

SEQ ID NO: 88992 - RNA, 1755 nt, Artificial Sequence; identical to SEQ ID NO: 87828
  derived and/or modified sequence opt1 from hemagglutinin__InfluenzaB__AHL92596

SEQ ID NO: 88993 - RNA, 1755 nt, Artificial Sequence; identical to SEQ ID NO: 87575
  derived and/or modified sequence opt1 from hemagglutinin__InfluenzaB__AHL92607

SEQ ID NO: 88994 - RNA, 1755 nt, Artificial Sequence
  derived and/or modified sequence opt1 from hemagglutinin__InfluenzaB__AHL92629
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgagaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaacauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcugaccguggaggugcccuacaucugcacggagggcgaggaccagaucaccgucuggggguuccacagcgacaacaagacccagaugaagaaccuguacggcgacuccaacccccagaaguucaccagcuccgccaacggggugacgacccacuacgugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagacgaagcacaagugcaaccagaccugccucgaccgcaucgccgcggggaccuucaacgccggcgaguucucccugcccaccuucgacagccugaacaucaccgccgccucccucaacgacgacgggcuggacaaccacacgauccugcuguacuacagcaccgccgcguccagccucgccgugacccugaugcuggccaucuucaucgucuacauggugucccgggacaacgugagcugcuccaucugccucuga

SEQ ID NO: 88995 - RNA, 1755 nt, Artificial Sequence; identical to SEQ ID NO: 87575
  derived and/or modified sequence opt1 from hemagglutinin__InfluenzaB__AHL92640

SEQ ID NO: 88996 - RNA, 1755 nt, Artificial Sequence; identical to SEQ ID NO: 87575
  derived and/or modified sequence opt1 from hemagglutinin__InfluenzaB__AHL92651

SEQ ID NO: 88997 - RNA, 1755 nt, Artificial Sequence
  derived and/or modified sequence opt1 from hemagglutinin__InfluenzaB__AHL92684
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggagaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaucauccugcuguacuacagcaccgccgcguccagccucgccgugacccugaugcuggccaucuucaucgucuacauggugucccgggacaacgugagcugcagcaucugccucuga

SEQ ID NO: 88998 - RNA, 1755 nt, Artificial Sequence; identical to SEQ ID NO: 87828
  derived and/or modified sequence opt1 from hemagglutinin__InfluenzaB__AHL92695

SEQ ID NO: 88999 - RNA, 1755 nt, Artificial Sequence; identical to SEQ ID NO: 87828
  derived and/or modified sequence opt1 from hemagglutinin__InfluenzaB__AHL92706

SEQ ID NO: 89000 - RNA, 1755 nt, Artificial Sequence
  derived and/or modified sequence opt1 from hemagglutinin__InfluenzaB__AHL92728
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagaucaucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcuccaucugccuguga

SEQ ID NO: 89001 - RNA, 1755 nt, Artificial Sequence; identical to SEQ ID NO: 89000
  derived and/or modified sequence opt1 from hemagglutinin__InfluenzaB__AHL92739

SEQ ID NO: 89002 - RNA, 1755 nt, Artificial Sequence; identical to SEQ ID NO: 89000
  derived and/or modified sequence opt1 from hemagglutinin__InfluenzaB__AHL92750

SEQ ID NO: 89003 - RNA, 1755 nt, Artificial Sequence; identical to SEQ ID NO: 87828
  derived and/or modified sequence opt1 from hemagglutinin__InfluenzaB__AHL92761

SEQ ID NO: 89004 - RNA, 1755 nt, Artificial Sequence
  derived and/or modified sequence opt1 from hemagglutinin__InfluenzaB__AHL92772
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcaugggcaccacgccguccgccaaggccagcauccugcacgaggugcgccccgucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcucccgcaguccggccgcaucguggucgacuacaugaugcagaagcccgggaagacgggcaccaucguguaccagcgcggggugcugcugccccagaaggucuggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcuccaucugccucuga

SEQ ID NO: 89005 - RNA, 1755 nt, Artificial Sequence; identical to SEQ ID NO: 87828
  derived and/or modified sequence opt1 from hemagglutinin__InfluenzaB__AHL92794

SEQ ID NO: 89006 - RNA, 1755 nt, Artificial Sequence; identical to SEQ ID NO: 87828
  derived and/or modified sequence opt1 from hemagglutinin__InfluenzaB__AHL92805

SEQ ID NO: 89007 - RNA, 1755 nt, Artificial Sequence; identical to SEQ ID NO: 87828
  derived and/or modified sequence opt1 from hemagglutinin__InfluenzaB__AHL92816

SEQ ID NO: 89008 - RNA, 1755 nt, Artificial Sequence
  derived and/or modified sequence opt1 from hemagglutinin__InfluenzaB__AHL92827
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucgucguguacauggugucccgggacaacgucagcugcuccaucugccucuga

SEQ ID NO: 89009 - RNA, 1755 nt, Artificial Sequence; identical to SEQ ID NO: 87828
  derived and/or modified sequence opt1 from hemagglutinin__InfluenzaB__AHL92838

SEQ ID NO: 89010 - RNA, 1755 nt, Artificial Sequence; identical to SEQ ID NO: 87828
  derived and/or modified sequence opt1 from hemagglutinin__InfluenzaB__AHL92849

SEQ ID NO: 89011 - RNA, 1755 nt, Artificial Sequence; identical to SEQ ID NO: 87828
  derived and/or modified sequence opt1 from hemagglutinin__InfluenzaB__AHL92860

SEQ ID NO: 89012 - RNA, 1758 nt, Artificial Sequence; identical to SEQ ID NO: 87646
  derived and/or modified sequence opt1 from hemagglutinin__InfluenzaB__AHL92871

SEQ ID NO: 89013 - RNA, 1755 nt, Artificial Sequence; identical to SEQ ID NO: 87434
  derived and/or modified sequence opt1 from hemagglutinin__InfluenzaB__AHL92882

SEQ ID NO: 89014 - RNA, 1758 nt, Artificial Sequence
  derived and/or modified sequence opt1 from hemagglutinin__InfluenzaB__AHL92893
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaaggagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucaucguguacauggugagccgggacaacgucuccugcagcaucugccuguga

SEQ ID NO: 89015 - RNA, 1755 nt, Artificial Sequence; identical to SEQ ID NO: 88031
  derived and/or modified sequence opt1 from hemagglutinin__InfluenzaB__AHL92904

SEQ ID NO: 89016 - RNA, 1758 nt, Artificial Sequence
  derived and/or modified sequence opt1 from hemagglutinin__InfluenzaB__AHL92915
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggucacgcucaugaucgccaucuucaucguguacauggugagccgggacaacgucuccugcagcaucugccuguga

SEQ ID NO: 89017 - RNA, 1758 nt, Artificial Sequence; identical to SEQ ID NO: 87646
  derived and/or modified sequence opt1 from hemagglutinin__InfluenzaB__AHL92926

SEQ ID NO: 89018 - RNA, 1755 nt, Artificial Sequence; identical to SEQ ID NO: 88607
  derived and/or modified sequence opt1 from hemagglutinin__InfluenzaB__AHL92937

SEQ ID NO: 89019 - RNA, 1758 nt, Artificial Sequence; identical to SEQ ID NO: 87522
  derived and/or modified sequence opt1 from hemagglutinin__InfluenzaB__AHL92948

SEQ ID NO: 89020 - RNA, 1758 nt, Artificial Sequence; identical to SEQ ID NO: 87522
  derived and/or modified sequence opt1 from hemagglutinin__InfluenzaB__AHL92959

SEQ ID NO: 89021 - RNA, 1758 nt, Artificial Sequence; identical to SEQ ID NO: 87522
  derived and/or modified sequence opt1 from hemagglutinin__InfluenzaB__AHL92970

SEQ ID NO: 89022 - RNA, 1758 nt, Artificial Sequence; identical to SEQ ID NO: 87522
  derived and/or modified sequence opt1 from hemagglutinin__InfluenzaB__AHL92981

SEQ ID NO: 89023 - RNA, 1758 nt, Artificial Sequence; identical to SEQ ID NO: 87522
  derived and/or modified sequence opt1 from hemagglutinin__InfluenzaB__AHL92992

SEQ ID NO: 89024 - RNA, 1758 nt, Artificial Sequence; identical to SEQ ID NO: 88947
  derived and/or modified sequence opt1 from hemagglutinin__InfluenzaB__AHL93004

SEQ ID NO: 89025 - RNA, 1758 nt, Artificial Sequence; identical to SEQ ID NO: 87522
  derived and/or modified sequence opt1 from hemagglutinin__InfluenzaB__AHL93015

SEQ ID NO: 89026 - RNA, 1758 nt, Artificial Sequence; identical to SEQ ID NO: 87522
  derived and/or modified sequence opt1 from hemagglutinin__InfluenzaB__AHL93026

SEQ ID NO: 89027 - RNA, 1755 nt, Artificial Sequence; identical to SEQ ID NO: 88971
  derived and/or modified sequence opt1 from hemagglutinin__InfluenzaB__AHL93037

SEQ ID NO: 89028 - RNA, 1755 nt, Artificial Sequence; identical to SEQ ID NO: 88971
  derived and/or modified sequence opt1 from hemagglutinin__InfluenzaB__AHL93048

SEQ ID NO: 89029 - RNA, 1755 nt, Artificial Sequence; identical to SEQ ID NO: 89000
  derived and/or modified sequence opt1 from hemagglutinin__InfluenzaB__AHL93059

SEQ ID NO: 89030 - RNA, 1755 nt, Artificial Sequence; identical to SEQ ID NO: 87828
  derived and/or modified sequence opt1 from hemagglutinin__InfluenzaB__AHL93070

SEQ ID NO: 89031 - RNA, 1755 nt, Artificial Sequence
  derived and/or modified sequence opt1 from hemagglutinin__InfluenzaB__AHL93081
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgagcuccacaacgagauccuggagcuggacggcaagguggacgaccuccgcgccgacacgaucagcucccagaucgagcuggcgguccugcucagcaacgagggcaucaucaacuccgaggacgagcaccuccuggcccuggagcggaagcugaagaagaugcuggggcccagcgccguggacaucggcaacgggugcuucgagaccaagcacaagugcaaccagaccugccucgaccgcaucgccgcgggcaccuucaacgccggggaguucucccugcccaccuucgacagccugaacaucacggccgccucccucaacgacgacggccuggacaaccacaccauccugcuguacuacagcaccgccgcguccagccucgccgugacccugaugcuggccaucuucaucgucuacauggugucccgggacaacgugagcugcuccaucugccucuga

SEQ ID NO: 89032 - RNA, 1755 nt, Artificial Sequence; identical to SEQ ID NO: 87828
  derived and/or modified sequence opt1 from hemagglutinin__InfluenzaB__AHL93092

SEQ ID NO: 89033 - RNA, 1755 nt, Artificial Sequence; identical to SEQ ID NO: 87828
  derived and/or modified sequence opt1 from hemagglutinin__InfluenzaB__AHL93103

SEQ ID NO: 89034 - RNA, 1755 nt, Artificial Sequence; identical to SEQ ID NO: 87828
  derived and/or modified sequence opt1 from hemagglutinin__InfluenzaB__AHL93114

SEQ ID NO: 89035 - RNA, 1755 nt, Artificial Sequence; identical to SEQ ID NO: 87575
  derived and/or modified sequence opt1 from hemagglutinin__InfluenzaB__AHL93125

SEQ ID NO: 89036 - RNA, 1755 nt, Artificial Sequence
  derived and/or modified sequence opt1 from hemagglutinin__InfluenzaB__AHL93136
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagcgcguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggacaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcuccaucugccucuga

SEQ ID NO: 89037 - RNA, 1755 nt, Artificial Sequence; identical to SEQ ID NO: 87575
  derived and/or modified sequence opt1 from hemagglutinin__InfluenzaB__AHL93147

SEQ ID NO: 89038 - RNA, 1755 nt, Artificial Sequence; identical to SEQ ID NO: 87828
  derived and/or modified sequence opt1 from hemagglutinin__InfluenzaB__AHL93158

SEQ ID NO: 89039 - RNA, 1755 nt, Artificial Sequence
  derived and/or modified sequence opt1 from hemagglutinin__InfluenzaB__AHL93169
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacgcggacccgcggcaagcucugccccgacugcuucaacugcaccgaccuggacguggcccuggggcggcccaugugcgugggcaccacgccguccgccaaggccagcauccuccacgagguccgccccgugaccuccggcugcuuccccaucaugcacgaccggaccaagauccgccagcugcccaaccugcuccggggguacgagaacauccgccugagcacccagaacgugaucgacgcggagaaggccccgggcgggcccuaccggcugggcacguccgggagcugccccaacgccaccuccaagaucggcuucuucgccaccauggcgugggccguccccaaggacaacuacaagaacgccaccaacccgcucacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcugccgcaguccggccgcaucgucguggacuacaugaugcagaagcccgggaagacgggcaccaucguguaccagcgcgggguccuccugccccagaagguguggugcgccagcggccgguccaaggugaucaagggcagccugccccucaucggggaggcggacugccugcacgagaaguacggcgggcugaacaagagcaagccguacuacaccggcgagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccucccacggggcccacggcguggccgucgcggccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcuccaucugccuguga

SEQ ID NO: 89040 - RNA, 1755 nt, Artificial Sequence
  derived and/or modified sequence opt1 from hemagglutinin__InfluenzaB__AHL93180
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucauccacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacaacaagacccagaugaagaaccuguacggcgacagcaacccccagaaguucacguccagcgccaacggggugaccacccacuacgugucccagaucggcagcuuccccgaccagaccgaggacggcgggcucccgcaguccggccgcaucgucguggacuacaugaugcagaagcccgggaagacgggcaccaucguguaccagcgcgggguccugcugccccagcgcguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccucuga

SEQ ID NO: 89041 - RNA, 1755 nt, Artificial Sequence
  derived and/or modified sequence opt1 from hemagglutinin__InfluenzaB__AHL93191
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgacaccuccaagaucggcuucuucgccaccauggccugggcgguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggccgacugccugcacgagaaguacggcgggcucaacaagagcaagccguacuacaccggcgagcacgcgaaggccaucgggaacugccccaucugggucaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccacggcguggccgucgccgcggaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgccgacacgaucagcucccagaucgagcuggccguccugcucagcaacgagggcaucaucaacuccgaggacgagcaccuccuggcgcuggagcggaagcugaagaagaugcugggccccagcgccguggacaucgggaacggcugcuucgagaccaagcacaagugcaaccagaccugccucgaccgcaucgccgccgggaccuucaacgcgggcgaguucucccugcccaccuucgacagccugaacaucacggccgccucccucaacgacgacgggcuggacaaccacaccauccugcuguacuacagcaccgccgccuccagccucgcggugacccugaugcuggccaucuucaucgucuacauggugucccgggacaacgugagcugcuccaucugccucuga

SEQ ID NO: 89042 - RNA, 1755 nt, Artificial Sequence
  derived and/or modified sequence opt1 from hemagglutinin__InfluenzaB__AHL93202
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcggcuguccggggccauggacgaguuccacaacgagauccucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcuccaucugccuguga

SEQ ID NO: 89043 - RNA, 1758 nt, Artificial Sequence; identical to SEQ ID NO: 87997
  derived and/or modified sequence opt1 from hemagglutinin__InfluenzaB__AHL93213

SEQ ID NO: 89044 - RNA, 1758 nt, Artificial Sequence; identical to SEQ ID NO: 87997
  derived and/or modified sequence opt1 from hemagglutinin__InfluenzaB__AHL93224

SEQ ID NO: 89045 - RNA, 1758 nt, Artificial Sequence
  derived and/or modified sequence opt1 from hemagglutinin__InfluenzaB__AHL93235
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacaacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 89046 - RNA, 1758 nt, Artificial Sequence
  derived and/or modified sequence opt1 from hemagglutinin__InfluenzaB__AHL93246
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgagcuccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacagccugggcgagcuggaggugaagaaccuccagcgccuguccggggccauggacgagcugcacaacgagauccucgagcuggacgagaaggucgacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccguggagaucggcaacgggugcuucgagaccaagcacaagugcaaccagaccugccuggaccggaucgccgccggcaccuucgacgcgggcgaguucucccuccccacguucgacagccugaacaucaccgccgccucccugaacgacgacgggcucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89047 - RNA, 1758 nt, Artificial Sequence; identical to SEQ ID NO: 87997
  derived and/or modified sequence opt1 from hemagglutinin__InfluenzaB__AHL93257

SEQ ID NO: 89048 - RNA, 1758 nt, Artificial Sequence; identical to SEQ ID NO: 88330
  derived and/or modified sequence opt1 from hemagglutinin__InfluenzaB__AHL93268

SEQ ID NO: 89049 - RNA, 1758 nt, Artificial Sequence
  derived and/or modified sequence opt1 from hemagglutinin__InfluenzaB__AHL93279
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggaaguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgggacaacgugagcugcuccaucugccuguga

SEQ ID NO: 89050 - RNA, 1758 nt, Artificial Sequence; identical to SEQ ID NO: 87997
  derived and/or modified sequence opt1 from hemagglutinin__InfluenzaB__AHL93290

SEQ ID NO: 89051 - RNA, 1758 nt, Artificial Sequence
  derived and/or modified sequence opt1 from hemagglutinin__InfluenzaB__AHL93301
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucaacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89052 - RNA, 1758 nt, Artificial Sequence
  derived and/or modified sequence opt1 from hemagglutinin__InfluenzaB__AHL93312
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuacgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89053 - RNA, 1758 nt, Artificial Sequence
  derived and/or modified sequence opt1 from hemagglutinin__InfluenzaB__AHL93323
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcaccagcgggcgguccaaggucaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucaccaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgucacccucaugaucgcgaucuucgugguguacauggucucccgcgacaacgugagcugcuccaucugccuguga

SEQ ID NO: 89054 - RNA, 1758 nt, Artificial Sequence
  derived and/or modified sequence opt1 from hemagglutinin__InfluenzaB__AHL93334
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacaucacgaacggcaacggcuucuucgccaccauggccugggccgucccgaagaacgacaagaacaagaccgcgaccaacccccugacgaucgaggugcccuacaucugcaccgagggggaggaccagaucaccguguggggcuuccacuccgacaacgagacccagauggccaagcucuacggggacagcaagccccagaaguucacguccagcgccaacggcgucaccacccacuacgugucccagaucggcggguucccgaaccagaccgaggacggcgggcugccccagagcggccggaucguggucgacuacauggugcagaaguccgggaagacgggcaccaucaccuaccagcgcggcauccugcucccccagaagguguggugcaccagcgggcgguccaaggucaucaagggcagccugccccugaucggggaggccgacugccuccacgagaaguacggcgggcugaacaagagcaagccguacuacacgggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccucccacggggcccacggcguggccgucgccgccgaccugaaguccacccaggaggcgaucaacaagaucaccaagaaccugaacucccucagcgagcuggaggugaagaaccugcagcgccucuccggcgccauggacgagcugcacaacgagauccuggagcucgacgagaaggucgacgaccugcgggccgacaccaucagcucccagaucgagcuggccgugcuccugagcaacgaggggaucaucaacuccgaggacgagcaccuccuggcccuggagcgcaagcugaagaagaugcucggccccagcgcgguggagaucgggaacggcugcuucgagaccaagcacaagugcaaccagaccugccuggaccggaucgccgccgggacguucgacgccggcgaguucucccugcccaccuucgacagccucaacaucaccgcggccucccugaacgacgacggccuggacaaccacaccauccuccuguacuacagcacggccgccuccagccuggccgucacccugaugaucgcgaucuucgugguguacauggucucccgcgacaacgugagcugcuccaucugccucuga

SEQ ID NO: 89055 - RNA, 1758 nt, Artificial Sequence; identical to SEQ ID NO: 87997
  derived and/or modified sequence opt1 from hemagglutinin__InfluenzaB__AHL93345

SEQ ID NO: 89056 - RNA, 1758 nt, Artificial Sequence; identical to SEQ ID NO: 87997
  derived and/or modified sequence opt1 from hemagglutinin__InfluenzaB__AHL93356

SEQ ID NO: 89057 - RNA, 1758 nt, Artificial Sequence
  derived and/or modified sequence opt1 from hemagglutinin__InfluenzaB__AHL93367
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgaguacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89058 - RNA, 1758 nt, Artificial Sequence; identical to SEQ ID NO: 87997
  derived and/or modified sequence opt1 from hemagglutinin__InfluenzaB__AHL93378

SEQ ID NO: 89059 - RNA, 1758 nt, Artificial Sequence
  derived and/or modified sequence opt1 from hemagglutinin__InfluenzaB__AHL93389
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagcuacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89060 - RNA, 1758 nt, Artificial Sequence; identical to SEQ ID NO: 87997
  derived and/or modified sequence opt1 from hemagglutinin__InfluenzaB__AHL93400

SEQ ID NO: 89061 - RNA, 1758 nt, Artificial Sequence; identical to SEQ ID NO: 88330
  derived and/or modified sequence opt1 from hemagglutinin__InfluenzaB__AHL93411

SEQ ID NO: 89062 - RNA, 1758 nt, Artificial Sequence; identical to SEQ ID NO: 88330
  derived and/or modified sequence opt1 from hemagglutinin__InfluenzaB__AHL93422

SEQ ID NO: 89063 - RNA, 1758 nt, Artificial Sequence; identical to SEQ ID NO: 88330
  derived and/or modified sequence opt1 from hemagglutinin__InfluenzaB__AHL93433

SEQ ID NO: 89064 - RNA, 1758 nt, Artificial Sequence; identical to SEQ ID NO: 87997
  derived and/or modified sequence opt1 from hemagglutinin__InfluenzaB__AHL93444

SEQ ID NO: 89065 - RNA, 1758 nt, Artificial Sequence
  derived and/or modified sequence opt1 from hemagglutinin__InfluenzaB__AHL93455
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccaugaacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89066 - RNA, 1758 nt, Artificial Sequence; identical to SEQ ID NO: 87997
  derived and/or modified sequence opt1 from hemagglutinin__InfluenzaB__AHL93466

SEQ ID NO: 89067 - RNA, 1758 nt, Artificial Sequence; identical to SEQ ID NO: 87616
  derived and/or modified sequence opt1 from hemagglutinin__InfluenzaB__AHL93477

SEQ ID NO: 89068 - RNA, 1758 nt, Artificial Sequence; identical to SEQ ID NO: 87691
  derived and/or modified sequence opt1 from hemagglutinin__InfluenzaB__AHL93488

SEQ ID NO: 89069 - RNA, 1755 nt, Artificial Sequence
  derived and/or modified sequence opt1 from hemagglutinin__InfluenzaB__AHL93499
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagauccgccccgucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccgcccacuacgugagccagaucggcgacuuccccgaccagaccgaggacggcgggcucccgcaguccggccgcaucguggucgacuacaugaugcagaagcccgggaagaccggcacgaucguguaccagcgcggggugcugcugccccagaaggucuggugcgcgagcggccgguccaaggugaucaagggcagccucccccugaucggggaggccgacugccugcacgagaaguacggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcgucgcgguggccgccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgcggacaccaucagcucccagaucgagcuggccgugcugcucagcaacgagggcaucaucaacuccgaggacgagcaccuccuggcccuggagcggaagcugaagaagaugcugggccccagcgccgucgacaucgggaacggcugcuucgagacgaagcacaagugcaaccagaccugccucgaccgcaucgcggccgggaccuucaacgccggcgaguucucccugcccaccuucgacagccugaacaucaccgccgccucccucaacgacgacgggcuggacaaccacacgauccugcuguacuacagcaccgcggccuccagccucgccgugacccugaugcuggccaucuucaucguguacauggucucccgggacaacgugagcugcuccaucugccucuga

SEQ ID NO: 89070 - RNA, 1758 nt, Artificial Sequence; identical to SEQ ID NO: 87616
  derived and/or modified sequence opt1 from hemagglutinin__InfluenzaB__AHL93510

SEQ ID NO: 89071 - RNA, 1755 nt, Artificial Sequence
  derived and/or modified sequence opt1 from hemagglutinin__InfluenzaB__AHL93521
augaaggccaucaucgcccugcucaugguggucaccagcaacgcggaccgcaucugcaccggcaucacguccagcaacagcccccacguggugaagaccgccacccagggggaggucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgcgaccauggccugggccgugcccaaggacaacuacaagaacgccaccaacccgcugacggucgaggugcccuacaucugcaccgagggcgaggaccagaucaccguguggggguuccacagcgacaacaagacccagaugaagaaccuguacggcgacuccaacccccagcgcuucacgagcuccgccaacggggucaccacccacuacgugagccagaucggcgacuuccccgaccagaccgaggacggcgggcucccgcaguccggccggaucguggucgacuacauggugcagaagcccgggaagacgggcaccaucguguaccagcgcgggguccugcugccccagaagguguggugcgcgagcggccgguccaaggugaucaagggcagccucccccugaucggggaggccgacugccugcacgagaaguacggcgggcucaacaagagcaagccguacuacaccggcgagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggcggacacgaucagcucccagaucgagcuggccguccugcucagcaacgagggcaucaucaacuccgaggacgagcaccuccuggcccuggagcgcaagcugaagaagaugcugggccccagcgccguggacaucgggaacggcugcuucgagaccaagcacaagugcaaccagaccugccucgaccggaucgcggccgggaccuucaacgccggcgaguucucccugcccaccuucgacagccugaacaucacggccgccucccucaacgacgacgggcuggacaaccacaccauccugcuguacuacagcaccgcggccuccagccucgccgugacccugaugcuggccaucuucaucgucuacauggugucccgcgacaacgugagcugcuccaucugccucuga

SEQ ID NO: 89072 - RNA, 1758 nt, Artificial Sequence; identical to SEQ ID NO: 87691
  derived and/or modified sequence opt1 from hemagglutinin__InfluenzaB__AHL93532

SEQ ID NO: 89073 - RNA, 1758 nt, Artificial Sequence; identical to SEQ ID NO: 87653
  derived and/or modified sequence opt1 from hemagglutinin__InfluenzaB__AHL93543

SEQ ID NO: 89074 - RNA, 1758 nt, Artificial Sequence; identical to SEQ ID NO: 87653
  derived and/or modified sequence opt1 from hemagglutinin__InfluenzaB__AHL93554

SEQ ID NO: 89075 - RNA, 1758 nt, Artificial Sequence; identical to SEQ ID NO: 87653
  derived and/or modified sequence opt1 from hemagglutinin__InfluenzaB__AHL93565

SEQ ID NO: 89076 - RNA, 1758 nt, Artificial Sequence; identical to SEQ ID NO: 87691
  derived and/or modified sequence opt1 from hemagglutinin__InfluenzaB__AHL93576

SEQ ID NO: 89077 - RNA, 1758 nt, Artificial Sequence; identical to SEQ ID NO: 87691
  derived and/or modified sequence opt1 from hemagglutinin__InfluenzaB__AHL93587

SEQ ID NO: 89078 - RNA, 1758 nt, Artificial Sequence
  derived and/or modified sequence opt1 from hemagglutinin__InfluenzaB__AHL93609
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaccgagcgcggcuucuucggggccaucgcgggcuuccucgagggcgggugggagggcaugaucgccggguggcacggcuacaccucccacggggcccacggcgucgccguggccgcggaccugaaguccacgcaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggacguucgacgcgggcgaguucucccugcccaccuucgacagccucaacaucaccgccgccucccugaacgacgacggccuggacaaccacaccauccuccuguacuacagcacggccgccuccagccuggcggugacccugaugaucgccaucuucguggucuacauggugucccgcgacaacgugagcugcuccaucugccucuga

SEQ ID NO: 89079 - RNA, 1758 nt, Artificial Sequence; identical to SEQ ID NO: 87691
  derived and/or modified sequence opt1 from hemagglutinin__InfluenzaB__AHL93620

SEQ ID NO: 89080 - RNA, 1758 nt, Artificial Sequence; identical to SEQ ID NO: 89078
  derived and/or modified sequence opt1 from hemagglutinin__InfluenzaB__AHL93631

SEQ ID NO: 89081 - RNA, 1758 nt, Artificial Sequence; identical to SEQ ID NO: 89078
  derived and/or modified sequence opt1 from hemagglutinin__InfluenzaB__AHL93642

SEQ ID NO: 89082 - RNA, 1755 nt, Artificial Sequence
  derived and/or modified sequence opt1 from hemagglutinin__InfluenzaB__AHL93653
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagaaccuguacggcgacuccaacccccagaaguucacgagcuccgccaacggggugaccacccacuacgugagccagaucggcgacuuccccgaccagaccgaggacggcgggcucccgcaguccggccgcaucgucguggacuacauggugcagaagcccgggaagacgggcaccaucgucuaccagcgcggggugcugcugccccagaagguguggugcgccagcggccgguccaaggucaucaagggcagccucccccugaucggggaggcggacugccugcacgagaaguacggcgggcucaacaagagcaagccguacuacaccggcgagcacgccaaggccaucggggacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggugaagaaccugcagcggcuguccggggccauggacgagcuccacaacgagauccuggagcuggacgagaaggucgacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgucacccugaugcuggccaucuucaucguguacauggugucccgggacaacgucagcugcuccaucugccucuga

SEQ ID NO: 89083 - RNA, 1758 nt, Artificial Sequence; identical to SEQ ID NO: 87691
  derived and/or modified sequence opt1 from hemagglutinin__InfluenzaB__AHL93664

SEQ ID NO: 89084 - RNA, 1758 nt, Artificial Sequence; identical to SEQ ID NO: 87616
  derived and/or modified sequence opt1 from hemagglutinin__InfluenzaB__AHL93675

SEQ ID NO: 89085 - RNA, 1758 nt, Artificial Sequence; identical to SEQ ID NO: 89078
  derived and/or modified sequence opt1 from hemagglutinin__InfluenzaB__AHL93686

SEQ ID NO: 89086 - RNA, 1758 nt, Artificial Sequence; identical to SEQ ID NO: 89078
  derived and/or modified sequence opt1 from hemagglutinin__InfluenzaB__AHL93697

SEQ ID NO: 89087 - RNA, 1758 nt, Artificial Sequence
  derived and/or modified sequence opt1 from hemagglutinin__InfluenzaB__AHL93708
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcaagcacgcgaaggccaucggcaacugccccaucugggugaagacgccccugaagcucgccaacgggaccaaguaccggcccccggccaagcugcugaccgagcgcggcuucuucggggccaucgcgggcuuccucgagggcgggugggagggcaugaucgccggguggcacggcuacaccucccacggggcccacggcgucgccguggccgcggaccugaaguccacgcaggaggccaucaacaagaucaccaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggacguucgacgcgggcgaguucucccugcccaccuucgacagccucaacaucaccgccgccucccugaacgacgacggccuggacaaccacaccauccuccuguacuacagcacggccgccuccagccuggcggugacccugaugaucgccaucuucguggucuacauggugucccgcgacaacgugagcugcuccaucugccucuga

SEQ ID NO: 89088 - RNA, 1758 nt, Artificial Sequence
  derived and/or modified sequence opt1 from hemagglutinin__InfluenzaB__AHL93719
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugauccccgucacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccgcaucgugguggacuacaugguccagaaguccgggaagacgggcaccaucaccuaccagcggggcauccuccugccccagaagguguggugcgccagcgggcgcuccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccguccugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgggacaacgucagcugcuccaucugccuguga

SEQ ID NO: 89089 - RNA, 1758 nt, Artificial Sequence; identical to SEQ ID NO: 87691
  derived and/or modified sequence opt1 from hemagglutinin__InfluenzaB__AHL93730

SEQ ID NO: 89090 - RNA, 1758 nt, Artificial Sequence; identical to SEQ ID NO: 87691
  derived and/or modified sequence opt1 from hemagglutinin__InfluenzaB__AHL93741

SEQ ID NO: 89091 - RNA, 1758 nt, Artificial Sequence; identical to SEQ ID NO: 87653
  derived and/or modified sequence opt1 from hemagglutinin__InfluenzaB__AHL93752

SEQ ID NO: 89092 - RNA, 1758 nt, Artificial Sequence; identical to SEQ ID NO: 89078
  derived and/or modified sequence opt1 from hemagglutinin__InfluenzaB__AHL93763

SEQ ID NO: 89093 - RNA, 1758 nt, Artificial Sequence; identical to SEQ ID NO: 87616
  derived and/or modified sequence opt1 from hemagglutinin__InfluenzaB__AHL93774

SEQ ID NO: 89094 - RNA, 1758 nt, Artificial Sequence; identical to SEQ ID NO: 89078
  derived and/or modified sequence opt1 from hemagglutinin__InfluenzaB__AHL93785

SEQ ID NO: 89095 - RNA, 1758 nt, Artificial Sequence; identical to SEQ ID NO: 87691
  derived and/or modified sequence opt1 from hemagglutinin__InfluenzaB__AHL93796

SEQ ID NO: 89096 - RNA, 1758 nt, Artificial Sequence; identical to SEQ ID NO: 87616
  derived and/or modified sequence opt1 from hemagglutinin__InfluenzaB__AHL93818

SEQ ID NO: 89097 - RNA, 1758 nt, Artificial Sequence
  derived and/or modified sequence opt1 from hemagglutinin__InfluenzaB__AHL93829
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacaccgagaacgccccgggcgggcccuacaagaucggcacguccgggagcugccccaacaucaccaacggcaacggcuucuucgcgaccauggccugggccgugcccaagaacgacaagaacaagaccgccacgaacccgcucaccaucgagguccccuacaucugcaccgagggggaggaccagaucaccguguggggcuuccacuccgacaacgagacgcagauggcgaagcuguacggggacagcaagccccagaaguucaccuccagcgccaacggcgugaccacccacuacgucucccagaucggcggguuccccaaccagacggaggacggcgggcugccgcagagcggccggaucgugguggacuacaugguccagaaguccgggaagaccggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucgucguguacauggugucccgcgacaacgucagcugcuccaucugccuguga

SEQ ID NO: 89098 - RNA, 1758 nt, Artificial Sequence; identical to SEQ ID NO: 87997
  derived and/or modified sequence opt1 from hemagglutinin__InfluenzaB__AHL93840

SEQ ID NO: 89099 - RNA, 1758 nt, Artificial Sequence; identical to SEQ ID NO: 87691
  derived and/or modified sequence opt1 from hemagglutinin__InfluenzaB__AHL93851

SEQ ID NO: 89100 - RNA, 1758 nt, Artificial Sequence; identical to SEQ ID NO: 87691
  derived and/or modified sequence opt1 from hemagglutinin__InfluenzaB__AHL93862

SEQ ID NO: 89101 - RNA, 1758 nt, Artificial Sequence
  derived and/or modified sequence opt1 from hemagglutinin__InfluenzaB__AHL93873
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcgagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 89102 - RNA, 1758 nt, Artificial Sequence; identical to SEQ ID NO: 87691
  derived and/or modified sequence opt1 from hemagglutinin__InfluenzaB__AHL93884

SEQ ID NO: 89103 - RNA, 1758 nt, Artificial Sequence; identical to SEQ ID NO: 87691
  derived and/or modified sequence opt1 from hemagglutinin__InfluenzaB__AHL93895

SEQ ID NO: 89104 - RNA, 1758 nt, Artificial Sequence; identical to SEQ ID NO: 87691
  derived and/or modified sequence opt1 from hemagglutinin__InfluenzaB__AHL93906

SEQ ID NO: 89105 - RNA, 1758 nt, Artificial Sequence; identical to SEQ ID NO: 87691
  derived and/or modified sequence opt1 from hemagglutinin__InfluenzaB__AHL93917

SEQ ID NO: 89106 - RNA, 1758 nt, Artificial Sequence; identical to SEQ ID NO: 87616
  derived and/or modified sequence opt1 from hemagglutinin__InfluenzaB__AHL93928

SEQ ID NO: 89107 - RNA, 1758 nt, Artificial Sequence; identical to SEQ ID NO: 87653
  derived and/or modified sequence opt1 from hemagglutinin__InfluenzaB__AHL93939

SEQ ID NO: 89108 - RNA, 1758 nt, Artificial Sequence; identical to SEQ ID NO: 87691
  derived and/or modified sequence opt1 from hemagglutinin__InfluenzaB__AHL93950

SEQ ID NO: 89109 - RNA, 1758 nt, Artificial Sequence; identical to SEQ ID NO: 87653
  derived and/or modified sequence opt1 from hemagglutinin__InfluenzaB__AHL93961

SEQ ID NO: 89110 - RNA, 1758 nt, Artificial Sequence
  derived and/or modified sequence opt1 from hemagglutinin__InfluenzaB__AHL93972
augaaggccaucaucgugcugcucauggucgugaccagcaccgccgaccgcaucugcacgggcaucaccuccagcaacagcccccacguggucaagaccgcgacccagggggaggugaacgugacgggcgucaucccgcugaccaccacccccaccaagagccacuucgccaaccugaaggggaccgagacccggggcaagcucugccccaagugccugaacugcaccgaccuggacguggcccucgggcgccccaagugcacgggcaagaucccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcacguccgggagcugccccaacgucaccaacggcaacggcuucuucgccaccauggccugggccgugcccaagaacgacaagaacaagaccgcgacgaacccgcucaccaucgaggugcccuacaucugcaccgagggggaggaccagaucaccgucuggggcuuccacuccgacaacgagacgcagauggccaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccgugggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacgcaggaggccaucaacaagaucaccaagaaccucaacucccugagcgagcuggaggugaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucgucguguacauggugucccgcgacaacgucagcugcuccaucugccuguga

SEQ ID NO: 89111 - RNA, 1758 nt, Artificial Sequence; identical to SEQ ID NO: 87616
  derived and/or modified sequence opt1 from hemagglutinin__InfluenzaB__AHL93983

SEQ ID NO: 89112 - RNA, 1755 nt, Artificial Sequence
  derived and/or modified sequence opt1 from hemagglutinin__InfluenzaB__AHL93994
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaagaaguccuacuucgccaaccugaaggggaccaagacgcggggcaagcucugccccgacugccugaacugcaccgaccuggacguggcccucgggcgccccaugugcgugggcaccaccccguccgccaaggccagcauccugcacgagguccggcccgugacguccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcaccuccgggagcugccccaacgccacguccaagagcggcuucuucgcgaccauggccugggccguccccaaggacaacaacaagaacgccaccaacccccugaccguggaggugccguacaucugcgccgagggcgaggaccagaucacggucuggggguuccacuccgacaacaagacccagaugaagaaccuguacggcgacagcaacccccagaaguucaccuccagcgcgaacggggugaccacgcacuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagaccaagcacaagugcaaccagacgugccucgaccggaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacaugaucagccgcgacaacguguccugcagcaucugccucuga

SEQ ID NO: 89113 - RNA, 1758 nt, Artificial Sequence; identical to SEQ ID NO: 87691
  derived and/or modified sequence opt1 from hemagglutinin__InfluenzaB__AHL94005

SEQ ID NO: 89114 - RNA, 1758 nt, Artificial Sequence; identical to SEQ ID NO: 87691
  derived and/or modified sequence opt1 from hemagglutinin__InfluenzaB__AHL94016

SEQ ID NO: 89115 - RNA, 1758 nt, Artificial Sequence
  derived and/or modified sequence opt1 from hemagglutinin__InfluenzaB__AHL94027
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagaugggcgugcuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgggacaacgugagcugcuccaucugccuguga

SEQ ID NO: 89116 - RNA, 1758 nt, Artificial Sequence; identical to SEQ ID NO: 87653
  derived and/or modified sequence opt1 from hemagglutinin__InfluenzaB__AHL94038

SEQ ID NO: 89117 - RNA, 1758 nt, Artificial Sequence; identical to SEQ ID NO: 87616
  derived and/or modified sequence opt1 from hemagglutinin__InfluenzaB__AHL94049

SEQ ID NO: 89118 - RNA, 1758 nt, Artificial Sequence; identical to SEQ ID NO: 87691
  derived and/or modified sequence opt1 from hemagglutinin__InfluenzaB__AHL94060

SEQ ID NO: 89119 - RNA, 1758 nt, Artificial Sequence
  derived and/or modified sequence opt1 from hemagglutinin__InfluenzaB__AHL94071
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugaugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucuccaagaucacgaagaaccucaacagccuguccgagcuggaggugaagaaccuccagcgccugagcggcgccauggacgagcugcacaacgagauccucgagcuggacgagaaggucgacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 89120 - RNA, 1755 nt, Artificial Sequence
  derived and/or modified sequence opt1 from hemagglutinin__InfluenzaB__AHL94082
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagauccgccccgucaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcucccgcaguccggccgcaucguggucgacuacaugaugcagaagcccgggaagacgggcaccaucguguaccagcgcggggugcugcugccccagaaggucuggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaccucaagagcacccaggaggccaucaacaagaucaccaagaaccugaacucccugagcgagcucgaggucaagaaccugcagcggcuguccggggccauggacgagcuccacaacgagauccuggagcuggacgagaagguggacgaccuccgcgccgacacgaucagcucccagaucgagcuggcggugcugcucagcaacgagggcaucaucaacuccgaggacgagcaccuccuggcccuggagcggaagcugaagaagaugcugggccccagcgccgucgacaucgggaacggcugcuucgagaccaagcacaagugcaaccagaccugccucgaccgcaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucguguacauggucucccgggacaacgugagcugcuccaucugccucuga

SEQ ID NO: 89121 - RNA, 1758 nt, Artificial Sequence; identical to SEQ ID NO: 87653
  derived and/or modified sequence opt1 from hemagglutinin__InfluenzaB__AHL94093

SEQ ID NO: 89122 - RNA, 1758 nt, Artificial Sequence; identical to SEQ ID NO: 87691
  derived and/or modified sequence opt1 from hemagglutinin__InfluenzaB__AHL94102

SEQ ID NO: 89123 - RNA, 1758 nt, Artificial Sequence
  derived and/or modified sequence opt1 from hemagglutinin__InfluenzaB__AHL94113
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagucccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccucaacaucacgaacggcaacggcuucuucgccaccauggccugggccgugcccaagaacgacaagaacaagaccgcgaccaacccccugacgaucgaggucccguacaucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcucccccagagcggccggaucgugguggacuacaugguccagaaguccgggaagacgggcaccaucaccuaccagcgcggcauccugcugccgcagaagguguggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugccccaucugggucaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcguggccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccguccugcucagcaacgaggggaucaucaacuccgaggacgagcaccuccuggcgcuggagcgcaagcugaagaagaugcugggccccagcgccguggagaucgggaacggcugcuucgagaccaagcacaagugcaaccagaccugccucgaccggaucgccgccgggaccuucgacgcgggcgaguucucccugcccacguucgacagccugaacaucaccgccgccucccucaacgacgacggccuggacaaccacaccauccugcuguacuacagcaccgccgccuccagccucgcggugacgcugaugaucgccaucuucgucguguacauggugucccgcgacaacgucagcugcuccaucugccuguga

SEQ ID NO: 89124 - RNA, 1758 nt, Artificial Sequence
  derived and/or modified sequence opt1 from hemagglutinin__InfluenzaB__AHL94124
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgagauccgccccgugacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89125 - RNA, 1758 nt, Artificial Sequence; identical to SEQ ID NO: 87616
  derived and/or modified sequence opt1 from hemagglutinin__InfluenzaB__AHL94135

SEQ ID NO: 89126 - RNA, 1758 nt, Artificial Sequence; identical to SEQ ID NO: 87616
  derived and/or modified sequence opt1 from hemagglutinin__InfluenzaB__AHL94146

SEQ ID NO: 89127 - RNA, 1758 nt, Artificial Sequence; identical to SEQ ID NO: 87691
  derived and/or modified sequence opt1 from hemagglutinin__InfluenzaB__AHL94157

SEQ ID NO: 89128 - RNA, 1758 nt, Artificial Sequence; identical to SEQ ID NO: 87691
  derived and/or modified sequence opt1 from hemagglutinin__InfluenzaB__AHL94168

SEQ ID NO: 89129 - RNA, 1758 nt, Artificial Sequence; identical to SEQ ID NO: 87616
  derived and/or modified sequence opt1 from hemagglutinin__InfluenzaB__AHL94179

SEQ ID NO: 89130 - RNA, 1758 nt, Artificial Sequence; identical to SEQ ID NO: 87616
  derived and/or modified sequence opt1 from hemagglutinin__InfluenzaB__AHL94190

SEQ ID NO: 89131 - RNA, 1758 nt, Artificial Sequence
  derived and/or modified sequence opt1 from hemagglutinin__InfluenzaB__AHL94201
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgagaccauggccugggccgugcccaagaacgacaagaacaagaccgccaccaacccgcucacgaucgagguccccuacaucugcaccgagggggaggaccagaucaccguguggggcuuccacuccgacaacgagacccagauggcgaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucgucguguacauggugucccgcaacaacgucagcugcuccaucugccuguga

SEQ ID NO: 89132 - RNA, 1758 nt, Artificial Sequence
  derived and/or modified sequence opt1 from hemagglutinin__InfluenzaB__AHL94212
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccaggucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 89133 - RNA, 1758 nt, Artificial Sequence; identical to SEQ ID NO: 87691
  derived and/or modified sequence opt1 from hemagglutinin__InfluenzaB__AHL94220

SEQ ID NO: 89134 - RNA, 1758 nt, Artificial Sequence; identical to SEQ ID NO: 87691
  derived and/or modified sequence opt1 from hemagglutinin__InfluenzaB__AHL94231

SEQ ID NO: 89135 - RNA, 1758 nt, Artificial Sequence
  derived and/or modified sequence opt1 from hemagglutinin__InfluenzaB__AHL94242
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccaacgggcggagcaaggugaucaagggcucccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 89136 - RNA, 1758 nt, Artificial Sequence; identical to SEQ ID NO: 87653
  derived and/or modified sequence opt1 from hemagglutinin__InfluenzaB__AHL94253

SEQ ID NO: 89137 - RNA, 1755 nt, Artificial Sequence
  derived and/or modified sequence opt1 from hemagglutinin__InfluenzaB__AHL94274
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89138 - RNA, 1755 nt, Artificial Sequence; identical to SEQ ID NO: 89137
  derived and/or modified sequence opt1 from hemagglutinin__InfluenzaB__AHL94295

SEQ ID NO: 89139 - RNA, 1755 nt, Artificial Sequence
  derived and/or modified sequence opt1 from hemagglutinin__InfluenzaB__AHL94306
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgcgaccauggccugggccgugcccaaggacaacuacaagaacgccaccaacccgcagacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcugccgcaguccggccgcaucguggucgacuacauggugcagaagcccgggaagacgggcaccaucguguaccagcgcgggguccuccugccccagaagguguggugcgcgagcggccgguccaaggugaucaagggcagccugccccucaucggggaggccgacugccugcacgagaaguacggcgggcugaacaagagcaagccguacuacaccggcgagcacgccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgcggacacgaucagcucccagaucgagcucgccguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgcggccgggaccuucaacgccggcgaguucucccuccccaccuucgacagccugaacaucacggccgccucccugaacgacgacgggcucgacaaccacaccauccugcuguacuacagcaccgcggccuccagccuggccgugacccucaugcuggccaucuucaucgucuacauggugucccgggacaacgugagcugcuccaucugccuguga

SEQ ID NO: 89140 - RNA, 1755 nt, Artificial Sequence
  derived and/or modified sequence opt1 from hemagglutinin__InfluenzaB__AHL94317
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggauccggacgcgcggcaagcucugccccgacugccugaacugcaccgaccuggacgucgcccucgggcggcccaugugcgugggcaccaccccguccgccaaggcgagcauccugcacgaggugcgccccgucacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgccacguccaagaucggcuucuucgcgaccauggccugggccgugccccgcgacaacuacaagaacgccaccaacccgcagaccgucgaggugcccuacaucugcacggagggcgaggaccagaucaccguguggggguuccacagcgacaacaagacccagaugaagaaccuguacggcgacuccaacccccagaaguucaccagcuccgccaacggggucacgacccacuacgugagccagaucggcgacuuccccgaccagaccgaggacggcgggcugccgcaguccggccggaucguggucgacuacauggugcagaagcccgggaagaccggcacgaucguguaccagcgcgggguccuccugccccagaagguguggugcgcgagcggccgguccaaggugaucaagggcagccugccccucaucggggaggccgacugccugcacgagaaguacggcgggcugaacaagagcaagccguacuacaccggcgagcacgccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcgccuguccggggccauggacgagcugcacaacgagauccucgagcuggacgagaagguggacgaccugcgggcggacaccaucagcucccagaucgagcucgccguccugcugagcaacgagggcaucaucaacuccgaggacgagcaccuccuggcccuggagcgcaagcucaagaagaugcugggccccagcgccguggacaucgggaacggcugcuucgagacgaagcacaagugcaaccagaccugccuggaccggaucgcggccgggaccuucaacgccggcgaguucucccuccccaccuucgacagccugaacaucaccgccgccucccugaacgacgacgggcucgacaaccacacgauccugcuguacuacagcaccgcggccuccagccuggccgugacccucaugcuggccaucuucaucgucuacauggugucccgcgacaacgugagcugcuccaucugccuguga

SEQ ID NO: 89141 - RNA, 1755 nt, Artificial Sequence; identical to SEQ ID NO: 89139
  derived and/or modified sequence opt1 from hemagglutinin__InfluenzaB__AHL94328

SEQ ID NO: 89142 - RNA, 1755 nt, Artificial Sequence; identical to SEQ ID NO: 89137
  derived and/or modified sequence opt1 from hemagglutinin__InfluenzaB__AHL94339

SEQ ID NO: 89143 - RNA, 1758 nt, Artificial Sequence
  derived and/or modified sequence opt1 from hemagglutinin__InfluenzaB__AHL94350
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacaugguguccaaggacaacgugagcugcuccaucugccuguga

SEQ ID NO: 89144 - RNA, 1758 nt, Artificial Sequence
  derived and/or modified sequence opt1 from hemagglutinin__InfluenzaB__AHL94361
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucgccuaccagcgcggcauccuccugccccagaaggucuggugcgccagcgggcgguccaaggugaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcgucgccguggcggccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgcggugcugcugagcaacgaggggaucaucaacuccgaggacgagcaccuccuggcccuggagcgcaagcucaagaagaugcugggccccagcgccgucgagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucguggucuacauggugucccgcgacagcguguccugcagcaucugccuguga

SEQ ID NO: 89145 - RNA, 1758 nt, Artificial Sequence
  derived and/or modified sequence opt1 from hemagglutinin__InfluenzaB__AHL94383
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggagaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 89146 - RNA, 1758 nt, Artificial Sequence; identical to SEQ ID NO: 87653
  derived and/or modified sequence opt1 from hemagglutinin__InfluenzaB__AHL94394

SEQ ID NO: 89147 - RNA, 1758 nt, Artificial Sequence
  derived and/or modified sequence opt1 from hemagglutinin__InfluenzaB__AHL94405
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucaacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89148 - RNA, 1758 nt, Artificial Sequence; identical to SEQ ID NO: 87653
  derived and/or modified sequence opt1 from hemagglutinin__InfluenzaB__AHL94416

SEQ ID NO: 89149 - RNA, 1755 nt, Artificial Sequence; identical to SEQ ID NO: 87862
  derived and/or modified sequence opt1 from hemagglutinin__InfluenzaB__AHL94427

SEQ ID NO: 89150 - RNA, 1755 nt, Artificial Sequence
  derived and/or modified sequence opt1 from hemagglutinin__InfluenzaB__AHL94438
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgagaccauggcgugggccgugcccaaggacaacuacaagaacgccaccaacccgcagacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcugccgcaguccggccgcaucguggucgacuacauggugcagaagcccgggaagacgggcaccaucguguaccagcgcgggguccuccugccccagaagguguggugcgccagcggccgguccaaggugaucaagggcagccugccccucaucggggaggcggacugccugcacgagaaguacggcgggcugaacaagagcaagccguacuacaccggcgagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccucccacggggcccacggcguggccgucgcggccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcuccaucugccuguga

SEQ ID NO: 89151 - RNA, 1755 nt, Artificial Sequence
  derived and/or modified sequence opt1 from hemagglutinin__InfluenzaB__AHL94460
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgcgaccauggccugggccgugcccaaggacaacuacaagaacgccaccaacccgcagacggucgaggugcccuacaucugcaccgaggaggaggaccagaucaccguguggggcuuccacagcgacaacaagacccagaugaagaaccuguacggggacuccaacccccagaaguucacgagcuccgccaacggcgucaccacccacuacgugagccagaucggggacuuccccgaccagaccgaggacggcggccugccgcaguccgggcgcaucguggucgacuacauggugcagaagcccggcaagacggggaccaucguguaccagcggggcguccuccugccccagaagguguggugcgcgagcgggcgcuccaaggugaucaagggcagccugccccucaucggcgaggccgacugccugcacgagaaguacgggggccugaacaagagcaagccguacuacaccggggagcacgccaaggccaucggcaacugccccaucugggucaagacgccccucaagcuggccaacgggaccaaguaccggcccccggcgaagcugcucaaggagcgcggcuucuucggcgccaucgccggguuccuggagggcgggugggagggcaugaucgccggguggcacggcuacaccucccacggcgcccacgggguggcggucgccgccgaccugaaguccacccaggaggccaucaacaagaucaccaagaaccucaacucccugagcgagcuggaggugaagaaccuccagcggcuguccggcgccauggacgagcugcacaacgagauccucgagcuggacgagaagguggacgaccugcgcgcggacacgaucagcucccagaucgagcucgccguccugcugagcaacgaggggaucaucaacuccgaggacgagcaccuccuggcccuggagcggaagcucaagaagaugcugggccccagcgccguggacaucggcaacgggugcuucgagaccaagcacaagugcaaccagaccugccuggaccgcaucgcggccggcaccuucaacgccggggaguucucccuccccaccuucgacagccugaacaucacggccgccucccugaacgacgacggccucgacaaccacaccauccugcuguacuacagcaccgcggccuccagccuggccgugacccucaugcuggccaucuucaucgucuacauggugucccgggacaacgugagcugcuccaucugccuguga

SEQ ID NO: 89152 - RNA, 1755 nt, Artificial Sequence
  derived and/or modified sequence opt1 from hemagglutinin__InfluenzaB__AHL94471
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacaucuccugcagcaucugccucuga

SEQ ID NO: 89153 - RNA, 1758 nt, Artificial Sequence
  derived and/or modified sequence opt1 from hemagglutinin__InfluenzaB__AHL94482
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucaccaccauggccugggccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 89154 - RNA, 1755 nt, Artificial Sequence; identical to SEQ ID NO: 89137
  derived and/or modified sequence opt1 from hemagglutinin__InfluenzaB__AHL94493

SEQ ID NO: 89155 - RNA, 1755 nt, Artificial Sequence; identical to SEQ ID NO: 89139
  derived and/or modified sequence opt1 from hemagglutinin__InfluenzaB__AHL94504

SEQ ID NO: 89156 - RNA, 1758 nt, Artificial Sequence
  derived and/or modified sequence opt1 from hemagglutinin__InfluenzaB__AHL94515
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcaccuacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggagaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 89157 - RNA, 1755 nt, Artificial Sequence; identical to SEQ ID NO: 89139
  derived and/or modified sequence opt1 from hemagglutinin__InfluenzaB__AHL94526

SEQ ID NO: 89158 - RNA, 1758 nt, Artificial Sequence
  derived and/or modified sequence opt1 from hemagglutinin__InfluenzaB__AHL94537
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacaucucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89159 - RNA, 1755 nt, Artificial Sequence
  derived and/or modified sequence opt1 from hemagglutinin__InfluenzaB__AHL94548
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaucaaguccuacuucgccaaccugaaggggaccaagacgcggggcaagcucugccccgacugccugaacugcaccgaccuggacguggcccucgggcgccccaugugcgugggcaccaccccguccgccaaggccagcauccugcacgagguccggcccgugacguccggcugcuuccccaucaugcacgaccgcaccaagauccggcagcuggcgaaccuccugcgcggguacgagaacauccggcugagcacccagaacgugaucgacgccgagcgcgcccccggcgggccguaccggcucggcaccuccgggagcugccccaacgccacguccaagagcggcuucuucgcgaccauggccugggccguccccaaggacaacaacaagaacgccaccaacccccugaccguggaggugccguacaucugcgccgagggcgaggaccagaucacggucuggggguuccacuccgacaacaagacccagaugaagaaccuguacggcgacagcaacccccagaaguucaccuccagcgcgaacggggugaccacgcacuacgugucccagaucggcggcuuccccgaccagaccgaggacgggggccucccccagagcgggcgcaucgucguggacuacaugaugcagaagccgggcaagaccgggaccaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagaccaagcacaagugcaaccagacgugccucgaccgcaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacauggugagccgggacaacguguccugcagcaucugccucuga

SEQ ID NO: 89160 - RNA, 1755 nt, Artificial Sequence; identical to SEQ ID NO: 89137
  derived and/or modified sequence opt1 from hemagglutinin__InfluenzaB__AHL94559

SEQ ID NO: 89161 - RNA, 1755 nt, Artificial Sequence; identical to SEQ ID NO: 87862
  derived and/or modified sequence opt1 from hemagglutinin__InfluenzaB__AHL94570

SEQ ID NO: 89162 - RNA, 1755 nt, Artificial Sequence; identical to SEQ ID NO: 87862
  derived and/or modified sequence opt1 from hemagglutinin__InfluenzaB__AHL94581

SEQ ID NO: 89163 - RNA, 1755 nt, Artificial Sequence; identical to SEQ ID NO: 87862
  derived and/or modified sequence opt1 from hemagglutinin__InfluenzaB__AHL94592

SEQ ID NO: 89164 - RNA, 1758 nt, Artificial Sequence
  derived and/or modified sequence opt1 from hemagglutinin__InfluenzaB__AHL94603
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagaacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89165 - RNA, 1758 nt, Artificial Sequence
  derived and/or modified sequence opt1 from hemagglutinin__InfluenzaB__AHL94614
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaucucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcuccaucugccuguga

SEQ ID NO: 89166 - RNA, 1755 nt, Artificial Sequence; identical to SEQ ID NO: 89139
  derived and/or modified sequence opt1 from hemagglutinin__InfluenzaB__AHL94624

SEQ ID NO: 89167 - RNA, 1758 nt, Artificial Sequence
  derived and/or modified sequence opt1 from hemagglutinin__InfluenzaB__AHL94646
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccucaacgucacgaacggcaacggcuucuucgccaccauggccugggccgugcccaagaacgacaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcucccccagagcggccggaucgucguggacuacauggugcagaaguccgggaagacgggcaccaucaccuaccagcgcggcauccugcugccgcagaaggucuggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugccccaucugggugaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugccucgaccggaucgccgccgggaccuucgacgcgggcgaguucucccugcccacguucgacagccugaacaucaccgccgccucccucaacgacgacggccuggacaaccacaccauccugcuguacuacagcaccgccgccuccagccucgcggugacgcugaugaucgccaucuucguggucuacauggugucccgcgacaacgugagcugcuccaucugccuguga

SEQ ID NO: 89168 - RNA, 1758 nt, Artificial Sequence
  derived and/or modified sequence opt1 from hemagglutinin__InfluenzaB__AHL94657
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgaguccgcgcccggcgggcccuacaagaucggcaccagcggguccugccccaacgucacgaacggcaacggcuucuucgccaccauggccugggccgugccgaagaacgacaagaacaagaccgcgaccgacccccugacgaucgaggugcccuacaucugcaccgagggggaggaccagaucaccgucuggggcuuccacagcgacaacgagacccagauggccaagcucuacggggacuccaagccccagaaguucacgagcuccgccaacggcgugaccacccacuacgugagccagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccacgagaaguacggcgggcugaacaaguccaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 89169 - RNA, 1755 nt, Artificial Sequence; identical to SEQ ID NO: 89139
  derived and/or modified sequence opt1 from hemagglutinin__InfluenzaB__AHL94668

SEQ ID NO: 89170 - RNA, 1755 nt, Artificial Sequence; identical to SEQ ID NO: 89139
  derived and/or modified sequence opt1 from hemagglutinin__InfluenzaB__AHL94679

SEQ ID NO: 89171 - RNA, 1758 nt, Artificial Sequence; identical to SEQ ID NO: 89164
  derived and/or modified sequence opt1 from hemagglutinin__InfluenzaB__AHL94690

SEQ ID NO: 89172 - RNA, 1758 nt, Artificial Sequence
  derived and/or modified sequence opt1 from hemagglutinin__InfluenzaB__AHL94701
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccugaccaagagccacuucgccaaccucaaggggacggagacccggggcaagcugugccccaagugccugaacugcaccgaccucgacguggcccuggggcgccccaagugcaccggcaagauccccuccgcccgggugagcauccugcacgagguccgcccggugacguccggcugcuuccccaucaugcacgaccggaccaagauccgccagcuccccaaccugcugcggggguacgagcacauccgccucagcacccacaacgugaucaacgccgagaacgcgcccggcgggccguacaagaucggcaccuccgggagcugccugaacgucacgaacggcaacggcuucuucgccaccauggccugggccgugcccaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccgcagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccgcugaucggggaggccgacugccuccacgagaaguacggcgggcugaacaagagcaagcccuacuacaccggcgagcacgcgaaggccaucggcaacugccccaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccugcucuacuacagcaccgccgccuccagccuggcggugacgcugaugaucgccaucuucguggucuacauggugucccgcgacaacgugagcugcuccaucugccucuga

SEQ ID NO: 89173 - RNA, 1755 nt, Artificial Sequence; identical to SEQ ID NO: 89137
  derived and/or modified sequence opt1 from hemagglutinin__InfluenzaB__AHL94712

SEQ ID NO: 89174 - RNA, 1758 nt, Artificial Sequence; identical to SEQ ID NO: 89168
  derived and/or modified sequence opt1 from hemagglutinin__InfluenzaB__AHL94723

SEQ ID NO: 89175 - RNA, 1755 nt, Artificial Sequence; identical to SEQ ID NO: 89137
  derived and/or modified sequence opt1 from hemagglutinin__InfluenzaB__AHL94734

SEQ ID NO: 89176 - RNA, 1758 nt, Artificial Sequence
  derived and/or modified sequence opt1 from hemagglutinin__InfluenzaB__AHL94745
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccucaacgucacgaacggcaacggcuucuucgccaccauggccugggccgugcccaagaacgacaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcucccccagagcggccggaucgucguggacuacauggugcagaaguccgggaagacgggcaccaucaccuaccagcgcggcauccugcugccgcagaaggucuggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugccccaucugggugaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugccucgaccggaucgccgccgggaccuucgacgcgggcgaguucucccugcccacguucgacagccugaacaucaccgccgccucccucaacggcgacgggcuggacaaccacaccauccugcuguacuacagcaccgccgccuccagccucgcggugacgcugaugaucgccaucuucguggucuacauggugucccgcgacaacgugagcugcuccaucugccuguga

SEQ ID NO: 89177 - RNA, 1755 nt, Artificial Sequence; identical to SEQ ID NO: 87862
  derived and/or modified sequence opt1 from hemagglutinin__InfluenzaB__AHL94756

SEQ ID NO: 89178 - RNA, 1758 nt, Artificial Sequence; identical to SEQ ID NO: 89167
  derived and/or modified sequence opt1 from hemagglutinin__InfluenzaB__AHL94766

SEQ ID NO: 89179 - RNA, 1755 nt, Artificial Sequence
  derived and/or modified sequence opt1 from hemagglutinin__InfluenzaB__AHL94777
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugcuucaacugcaccgaccuggacgucgcccuggggcggcccaugugcgugggcaccacgccguccgccaaggcgagcauccuccacgaggugcgccccgucaccuccggcugcuuccccaucaugcacgaccggaccaagauccgccagcugcccaaccugcuccggggguacgagaacauccgccugagcacccagaacgccaucgacgccgagaaggccccgggcgggcccuaccggcugggcacguccgggagcugccccaacgcgaccuccaagaucggcuucuucgccaccauggccugggccgugcccaaggacaacuacaagaacgccaccaacccgcagacgguggagguccccuacaucugcaccgagggcgaggaccagaucaccguguggggguuccacagcgacaacaagacccagaugaagaaccucuacggcgacuccaacccccagaaguucacgagcuccgcgaacggggugaccacccacuacgucagccagaucggcgacuuccccgaccagaccgaggacggcgggcugccgcaguccggccgcaucgugguggacuacaugguccagaagcccgggaagacgggcaccaucguguaccagcgcggggugcugcucccccagaaggucuggugcgccagcggccgguccaaggugaucaagggcagccugccccugaucggggaggccgacugccuccacgagaaguacggcgggcugaacaagagcaagccguacuacaccggcgagcacgccaaggccaucgggaacugccccaucugggugaagacgccccugaagcucgcgaacggcaccaaguaccggcccccggccaagcugcugaaggagcgcggcuucuucggggccaucgccggcuuccucgagggcgggugggaggggaugaucgccggcuggcacggcuacaccucccacggggcgcacggcgucgccguggccgccgaccugaaguccacccaggaggccaucaacaagaucaccaagaaccugaacucccucagcgagcuggaggucaagaaccugcagcggcucuccggggcgauggacgagcugcacaacgagauccuggagcucgacgagaagguggacgaccugcgcgccgacacgaucagcucccagaucgagcuggccgugcuccugagcaacgagggcaucaucaacuccgaggacgagcaccuccuggcccuggagcggaagcugaagaagaugcucggccccagcgcggucgacaucgggaacggcugcuucgagaccaagcacaagugcaaccagaccugccuggaccgcaucgccgccgggaccuucaacgccggcgaguucucccugcccaccuucgacagccucaacaucacggccgcgucccugaacgacgacgggcuggacaaccacaccauccuccuguacuacagcaccgccgccuccagccuggccgugacccugaugcucgccaucuucaucguguacauggucucccgggacaacgugagcugcuccaucugccuguga

SEQ ID NO: 89180 - RNA, 1758 nt, Artificial Sequence; identical to SEQ ID NO: 89164
  derived and/or modified sequence opt1 from hemagglutinin__InfluenzaB__AHL94797

SEQ ID NO: 89181 - RNA, 1755 nt, Artificial Sequence
  derived and/or modified sequence opt1 from hemagglutinin__InfluenzaB__AHL94808
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggauccggacgcgcggcaagcucugccccgacugccugaacugcaccgaccuggacgucgcccucgggcggcccaugugcgugggcaccaccccguccgccaaggcgagcauccugcacgaggugcgccccgucacguccggcugcuuccccaucaugcacgaccggaccaagauccgccagcugcccaaccuccugcggggguacgagaacauccgccugagcacccagaacgugaucgacgccgagaaggccccgggcgggcccuaccggcucggcaccuccgggagcugccccaacgccacguccaagaucggcuucuucgcgaccauggccugggccgugcccaaggacaacuacaagaacgccaccaacccgcagaccgucgaggugcccuacaucugcacggagggcgaggaccagaucaccguguggggguuccacagcgacaacaagacccagaugaagaaccuguacggcgacuccaacccccagaaguucaccagcuccgccaacggggucacgacccacuacgugagccagaucggcgacuuccccgaccagaccgaggacggcgggcugccgcaguccggccgcaucguggucgacuacauggugcagaagcccgggaagaccggcacgaucguguaccagcgcgggguccuccugccccagaagguguggugcgcgagcggccgguccaaggugaucaagggcagccugccccucaucggggaggccgacugccugcacgagaaguacggcgggcugaacaagagcaagccguacuacaccggcgagcacgccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcggcuguccggggccauggacgagcugcacaacgagauccucgagcuggacgagaagguggacgaccugcgcgcggacaccaucagcucccagaucgagcucgccguccugcugagcaacgagggcaucaucaacuccgaggacgagcaccuccuggcccuggagcggaagcucaagaagaugcugggccccagcgccguggacaucgggaacggcugcuucgagacgaagcacaagugcaaccagaccugccuggaccgcaucgcggccgggaccuucaacgccggcgaguucucccuccccaccuucgacagccugaacaucaccgccgccucccugaacgacgacgggcucgacaaccacacgauccugcuguacuacagcaccgcggccuccagccuggccgugacccucaugcuggccaucuucaucgucuacauggugucccgggacaacgugagcugcuccaucugccuguga

SEQ ID NO: 89182 - RNA, 1755 nt, Artificial Sequence
  derived and/or modified sequence opt1 from hemagglutinin__InfluenzaB__AHL94817
augaaggccaucaucgugcugcucauggucgugaccagcaacgccgaccgcaucugcaccggcaucacguccagcaacagcccccacguggucaagaccgcgacccagggggaggugaacgugaccggcgccaucccgcugacgaccacccccaccaagagcuacuucgccaaccugaaggggacgcggacccgcggcaagcucugccccgacugccugaacugcaccgaccuggacgucgcccucgggcggcccaugugcgugggcaccacgccguccgccaaggcgagcauccugcacgaggugcgccccgucaccuccggcugcuuccccaucaugcacgaccggaccaagauccgccagcugcccaaccuccugcggggguacgagaacauccgccugagcacccagaacgugaucgacgccgagaaggccccgggcgggcccuaccggcucggcacguccgggagcugccccaacgccaccuccaagaucggcuucuucgcgaccauggccugggccgugcccaaggacaacuacaagaacgccaccaacccgcagacggucgaggugcccuacaucugcaccgagggcgaggaccagaucaccguguggggguuccacagcgacaacaagacccagaugaagaaccuguacggcgacuccaacccccagaaguucacgagcuccgccaacggggucaccacccacuacgugagccagaucggcgacuuccccgaccagaccgaggacggcgggcugccgcaguccggccgcaucguggucgacuacauggugcagaagcccgggaagacgggcaccaucguguaccagcgcgggguccuccugccccagaagguguggugcgcgagcggccgguccaaggugaucaagggcagccugccccucaucggggaggccgacugccugcacgagaaguacggcgggcugaacaagagcaagccguacuacaccggcgagcacgccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccucccacggggcccacggcguggcggucgccgccgaccugaaguccacccaggaggccaucaacaagaucaccaagaaccucaacucccugagcgagcuggaggugaagaaccuccagcggcuguccggggccauggacgagcugcacaacgagaucaucgagcucgacgagaagguggacgaccugcgcgcggacacgaucagcucccagaucgagcuggccguccuccugagcaacgagggcaucaucaacuccgaggacgagcaccuccuggcccuggagcggaagcugaagaagaugcucggccccagcgccguggacaucgggaacggcugcuucgagaccaagcacaagugcaaccagaccugccuggaccgcaucgcggccgggaccuucaacgccggcgaguucucccugcccaccuucgacagccucaacaucacggccgccucccugaacgacgacgggcuggacaaccacaccauccuccuguacuacagcaccgcggccuccagccuggccgugacccugaugcucgccaucuucaucgucuacauggugucccgggacaacgugagcugcuccaucugccuguga

SEQ ID NO: 89183 - RNA, 1758 nt, Artificial Sequence; identical to SEQ ID NO: 88873
  derived and/or modified sequence opt1 from hemagglutinin__InfluenzaB__AHL94827

SEQ ID NO: 89184 - RNA, 1755 nt, Artificial Sequence
  derived and/or modified sequence opt1 from hemagglutinin__InfluenzaB__AHL94837
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguacgagaacauccgccugagcacccagaacgugaucgacgccgagaaggccccgggcgggcccuacaagcucggcaccuccgggagcugccccaacgccacguccaagaucggcuucuucgcgaccauggccugggccguccccaaggacaacuacaagaacgccaccaacccgcugaccguggaggugcccuacaucugcaaggagggcgaggaccagaucacggucuggggguuccacagcgacaacaagacccagaugaagaaccuguacggcgacuccaacccccagaaguucaccagcuccgccaacggggugaccacgcacuacgugagccagaucggcgacuuccccgaccagaccgaggacggcgggcucccgcaguccggccggaucgucguggacuacaugaugcagaagcccgggaagaccggcaccaucguguaccagcgcgggguccugcugccccagaagguguggugcgcgagcggccgguccaaggugaucaagggcagccucccccugaucggggaggccgacugccugcacgaggaguacggcgggcucaacaagagcaagccguacuacacgggcaagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggcggacaccaucagcucccagaucgagcuggccguccugcucagcaacgagggcaucaucaacuccgaggacgagcaccuccuggcccuggagcgcaagcugaagaagaugcugggccccagcgccguggacaucgggaacggcugcuucgagaccaagcacaagugcaaccagacgugccucgaccggaucgcggccgggaccuucaacgccggcgaguucucccugcccaccuucgacagccugaacaucaccgccgccucccucaacgacgacgggcuggacaaccacaccauccugcuguacuacagcacggcggccuccagccucgccgugacccugaugcuggccaucuucaucgucuacauggugucccgcgacaacgugagcugcuccaucugccucuga

SEQ ID NO: 89185 - RNA, 1755 nt, Artificial Sequence; identical to SEQ ID NO: 87862
  derived and/or modified sequence opt1 from hemagglutinin__InfluenzaB__AHL94847

SEQ ID NO: 89186 - RNA, 1758 nt, Artificial Sequence
  derived and/or modified sequence opt1 from hemagglutinin__InfluenzaB__AHL94858
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaaggccggcacgaucaccuaccagcgcggcauccuccugccgcagaaggucuggugcgccuccgggcggagcaaggugaucaagggcagccugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuucuucggggcgaucgccggcuuccuggagggcgggugggagggcaugaucgccggguggcacggcuacaccagccacggggcccacggcgucgccguggcggccgaccugaaguccacccaggaggccaucaacaagaucaccaagaaccucaacagccuguccgagcuggaggucaagaaccuccagcgccugagcggcgccauggacgagcugcacaacgagauccucgagcuggacgagaagguggacgaccugcgggccgacacgaucuccagccagaucgagcucgcggugcugcuguccaacgaggggaucaucaacagcgaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuucgacgccggcgaguucagccuccccaccuucgacucccugaacaucacggccgccagccugaacgacgacggccucgacaaccacaccauccugcuguacuacuccaccgccgcgagcucccuggccgugacccucaugaucgccaucuucguggucuacauggugagccgcgacaacguguccugcagcaucugccuguga

SEQ ID NO: 89187 - RNA, 1755 nt, Artificial Sequence; identical to SEQ ID NO: 87828
  derived and/or modified sequence opt1 from hemagglutinin__InfluenzaB__AHL94869

SEQ ID NO: 89188 - RNA, 1758 nt, Artificial Sequence; identical to SEQ ID NO: 87997
  derived and/or modified sequence opt1 from hemagglutinin__InfluenzaB__AHL94880

SEQ ID NO: 89189 - RNA, 1758 nt, Artificial Sequence; identical to SEQ ID NO: 88330
  derived and/or modified sequence opt1 from hemagglutinin__InfluenzaB__AHL94889

SEQ ID NO: 89190 - RNA, 1758 nt, Artificial Sequence; identical to SEQ ID NO: 87997
  derived and/or modified sequence opt1 from hemagglutinin__InfluenzaB__AHL94900

SEQ ID NO: 89191 - RNA, 1758 nt, Artificial Sequence
  derived and/or modified sequence opt1 from hemagglutinin__InfluenzaB__AHL94911
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggcgcacgggcaccaucaccuaccagcggggcauccugcucccccagaaggucuggugcgccagcgggcgcuccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcggcucuccggcgccauggacgagcugcacaacgagauccuggagcucgacgagaagguggacgaccugcgcgccgacaccaucagcucccagaucgagcuggccgugcuccugagcaacgaggggaucaucaacuccgaggacgagcaccuccuggcgcuggagcggaagcugaagaagaugcucggccccagcgccgucgagaucgggaacggcugcuucgagaccaagcacaagugcaaccagaccugccuggaccgcaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgggacaacgugagcugcuccaucugccucuga

SEQ ID NO: 89192 - RNA, 1758 nt, Artificial Sequence; identical to SEQ ID NO: 87997
  derived and/or modified sequence opt1 from hemagglutinin__InfluenzaB__AHL94922

SEQ ID NO: 89193 - RNA, 1758 nt, Artificial Sequence
  derived and/or modified sequence opt1 from hemagglutinin__InfluenzaB__AHL94933
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaaggccggcacgaucaccuaccagcgcggcauccuccugccccagaagguguggugcgccagcgggcgguccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgcggugcugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgucacccucaugaucgccaucuucgugguguacauggucucccgcgacaacgugagcugcuccaucugccuguga

SEQ ID NO: 89194 - RNA, 1758 nt, Artificial Sequence; identical to SEQ ID NO: 89078
  derived and/or modified sequence opt1 from hemagglutinin__InfluenzaB__AHL94944

SEQ ID NO: 89195 - RNA, 1758 nt, Artificial Sequence; identical to SEQ ID NO: 87691
  derived and/or modified sequence opt1 from hemagglutinin__InfluenzaB__AHL94955

SEQ ID NO: 89196 - RNA, 1758 nt, Artificial Sequence; identical to SEQ ID NO: 87691
  derived and/or modified sequence opt1 from hemagglutinin__InfluenzaB__AHL94965

SEQ ID NO: 89197 - RNA, 1758 nt, Artificial Sequence; identical to SEQ ID NO: 87691
  derived and/or modified sequence opt1 from hemagglutinin__InfluenzaB__AHL94975

SEQ ID NO: 89198 - RNA, 1755 nt, Artificial Sequence; identical to SEQ ID NO: 87862
  derived and/or modified sequence opt1 from hemagglutinin__InfluenzaB__AHM00986

SEQ ID NO: 89199 - RNA, 1758 nt, Artificial Sequence; identical to SEQ ID NO: 87895
  derived and/or modified sequence opt1 from hemagglutinin__InfluenzaB__AHM00997

SEQ ID NO: 89200 - RNA, 1758 nt, Artificial Sequence
  derived and/or modified sequence opt1 from hemagglutinin__InfluenzaB__AHM01008
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccuggaccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 89201 - RNA, 1758 nt, Artificial Sequence; identical to SEQ ID NO: 87895
  derived and/or modified sequence opt1 from hemagglutinin__InfluenzaB__AHM01019

SEQ ID NO: 89202 - RNA, 1758 nt, Artificial Sequence; identical to SEQ ID NO: 87895
  derived and/or modified sequence opt1 from hemagglutinin__InfluenzaB__AHM01030

SEQ ID NO: 89203 - RNA, 1758 nt, Artificial Sequence
  derived and/or modified sequence opt1 from hemagglutinin__InfluenzaB__AHM01041
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgagaagacggggaccaucaccuaccagcgcggcauccuccugccccagaaggucuggugcgccagcggccgguccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccgucgagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89204 - RNA, 1758 nt, Artificial Sequence
  derived and/or modified sequence opt1 from hemagglutinin__InfluenzaB__AHM01052
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccaucaugcuguacuacagcaccgccgccuccagccuggcggugacgcugaugaucgccaucuucguggucuacauggugucccgcgacaacgugagcugcuccaucugccucuga

SEQ ID NO: 89205 - RNA, 1758 nt, Artificial Sequence; identical to SEQ ID NO: 87895
  derived and/or modified sequence opt1 from hemagglutinin__InfluenzaB__AHM01063

SEQ ID NO: 89206 - RNA, 1755 nt, Artificial Sequence; identical to SEQ ID NO: 87862
  derived and/or modified sequence opt1 from hemagglutinin__InfluenzaB__AHM01074

SEQ ID NO: 89207 - RNA, 1755 nt, Artificial Sequence
  derived and/or modified sequence opt1 from hemagglutinin__InfluenzaB__AHM01096
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcauccugcugccccagaaggucuggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacggggucgccguggccgccgaccucaaguccacccaggaggccaucaacaagaucaccaagaaccugaacagccuguccgagcucgaggucaagaaccugcagcgccugagcggcgcgauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcggucgacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucguguacauggucagccgcgacaacguguccugcagcaucugccucuga

SEQ ID NO: 89208 - RNA, 1758 nt, Artificial Sequence; identical to SEQ ID NO: 87895
  derived and/or modified sequence opt1 from hemagglutinin__InfluenzaB__AHM01107

SEQ ID NO: 89209 - RNA, 1758 nt, Artificial Sequence
  derived and/or modified sequence opt1 from hemagglutinin__InfluenzaB__AHM01118
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgugucccugaacgacgacggccucgacaaccacaccauccugcuguacuacagcaccgccgccuccagccuggccgugacgcucaugaucgcgaucuucgucguguacauggugucccgcgacaacgucagcugcuccaucugccuguga

SEQ ID NO: 89210 - RNA, 1758 nt, Artificial Sequence; identical to SEQ ID NO: 87895
  derived and/or modified sequence opt1 from hemagglutinin__InfluenzaB__AHM01129

SEQ ID NO: 89211 - RNA, 1758 nt, Artificial Sequence
  derived and/or modified sequence opt1 from hemagglutinin__InfluenzaB__AHM01140
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcgcccacaacgugaucaacgcggagaacgccccgggcgggcccuacaagaucggcaccuccgggagcugccccaacgucaccaacggcaacggcuucuucgccacgauggccugggcggugcccaagaacgacaagaacaagaccgccaccaacccgcucaccaucgaggugcccuacaucugcacggagggggaggaccagaucaccgucuggggcuuccacuccgacaacgagacccagauggccaagcuguacggggacagcaagccccagaaguucaccuccagcgccaacggcgugacgacccacuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccagcgggcgguccaaggugaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcgucgccguggcggccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgcggugcugcugagcaacgaggggaucaucaacuccgaggacgagcaccuccuggcccuggagcgcaagcucaagaagaugcugggccccagcgccgucgagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucguggucuacauggugucccgcgacaacgugagcugcuccaucugccuguga

SEQ ID NO: 89212 - RNA, 1758 nt, Artificial Sequence; identical to SEQ ID NO: 87880
  derived and/or modified sequence opt1 from hemagglutinin__InfluenzaB__AHM01151

SEQ ID NO: 89213 - RNA, 1758 nt, Artificial Sequence
  derived and/or modified sequence opt1 from hemagglutinin__InfluenzaB__AHM01162
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccaaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89214 - RNA, 1755 nt, Artificial Sequence; identical to SEQ ID NO: 87862
  derived and/or modified sequence opt1 from hemagglutinin__InfluenzaB__AHM01173

SEQ ID NO: 89215 - RNA, 1758 nt, Artificial Sequence
  derived and/or modified sequence opt1 from hemagglutinin__InfluenzaB__AHM01184
augaaggccaucaucgugcugcucauggucgugaccagcaacgccgaccgcaucugcaccggcaucacguccagcaacagcccccacguggucaagaccgcgacccagggggaggugaacgugaccggcgucaucacgcugaccaccaccccgacgaagucccacuucgccaaccugaaggggaccgagacccggggcaagcucugccccaagugccugaacugcaccgaccuggacguggcccucgggcgccccaagugcacgggcaagauccccuccgcccgggugagcauccugcacgagguccgcccggugaccuccggcugcuuccccaucaugcacgaccggaccaagauccgccagcugcccaaccuccugcggggguacgagcacauccgccugagcacccacaacgugaucaacgccgaggacgcgcccggcgggccguacaagaucggcacguccgggagcugccccaacgucaccaacggcaacggcuucuucgccaccauggccugggccgugcccaagaacgacaagaacaagaccgcgacgaacccccucaccaucgaggugccguacaucugcaccgagggggaggaccagaucaccgucuggggcuuccacuccgacaacgagacgcagauggccaagcuguacggggacagcaagccccagaaguucaccuccagcgccaacggcgugaccacccacuacgugucccagaucggcggguuccccaaccagacggaggacggcgggcugccccagagcggccggaucgucguggacuacauggugcagaaguccgggaagaccggcaccaucaccuaccagcgcggcauccuccugccgcagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccucaagagcacgcaggaggccaucaacaagaucaccaagaaccugaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcuccaucugccuguga

SEQ ID NO: 89216 - RNA, 1758 nt, Artificial Sequence; identical to SEQ ID NO: 89211
  derived and/or modified sequence opt1 from hemagglutinin__InfluenzaB__AHM01195

SEQ ID NO: 89217 - RNA, 1758 nt, Artificial Sequence
  derived and/or modified sequence opt1 from hemagglutinin__InfluenzaB__AHM01206
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgagaagacggggaccaucaccuaccagcgcggcauccuccugccccagaaggucuggugcgccagcggccgguccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgagggcaucaucaacuccgaggacgagcaccuccuggcgcuggagcgcaagcucaagaagaugcuggggcccagcgccgucgagaucggcaacgggugcuucgagaccaagcacaagugcaaccagaccugccuggaccggaucgccgccggcaccuucgacgcgggggaguucucccuccccacguucgacagccugaacaucaccgccgccucccugaacgacgacggccucggcaaccacaccauccugcuguacuacagcaccgccgccuccagccuggcggugacgcucaugaucgccaucuucguggucuacauggugucccgcgacaacgugagcugcuccaucugccuguga

SEQ ID NO: 89218 - RNA, 1758 nt, Artificial Sequence; identical to SEQ ID NO: 87880
  derived and/or modified sequence opt1 from hemagglutinin__InfluenzaB__AHM01217

SEQ ID NO: 89219 - RNA, 1755 nt, Artificial Sequence; identical to SEQ ID NO: 87862
  derived and/or modified sequence opt1 from hemagglutinin__InfluenzaB__AHM01228

SEQ ID NO: 89220 - RNA, 1758 nt, Artificial Sequence; identical to SEQ ID NO: 87895
  derived and/or modified sequence opt1 from hemagglutinin__InfluenzaB__AHM01239

SEQ ID NO: 89221 - RNA, 1758 nt, Artificial Sequence; identical to SEQ ID NO: 87895
  derived and/or modified sequence opt1 from hemagglutinin__InfluenzaB__AHM01250

SEQ ID NO: 89222 - RNA, 1758 nt, Artificial Sequence
  derived and/or modified sequence opt1 from hemagglutinin__InfluenzaB__AHM01261
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccaucuggggcuuccacuccgacaacgagacccagauggccaagcuguacggggacagcaacccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccgggggccggagcaaggucaucaaggggucccugccccucaucggcgaggccgacugccugcacgagaaguacgggggccugaacaagagcaagcccuacuacaccggcgagcacgcgaaggccaucgggaacugcccgaucugggugaagacgccccucaagcuggccaacggcaccaaguaccgcccgcccgccaagcugcucaaggagcggggguucuucggcgccaucgcgggguuccuggagggcggcugggaggggaugaucgccggcuggcacggguacaccagccacggcgcccacggcguggccgucgccgcggaccugaaguccacccaggaggccaucaacaagaucacgaagaaccucaacagccuguccgagcuggaggugaagaaccuccagcgccugagcggggccauggacgagcugcacaacgagauccucgagcuggacgagaaggucgacgaccugcgggccgacaccaucuccagccagaucgagcucgccgugcugcuguccaacgagggcaucaucaacagcgaggacgagcaccuccuggcgcuggagcgcaagcucaagaagaugcuggggcccuccgccguggagaucggcaacgggugcuucgagaccaagcacaagugcaaccagaccugccuggaccggaucgccgccggcaccuucgacgcgggcgaguucagccuccccacguucgacucccugaacaucaccgccgccagccugaacgacgacgggcucgacaaccacaccauccugcuguacuacuccaccgccgccagcucccuggcggucacgcucaugaucgccaucuucgugguguacauggucagccgcgacaacguguccugcagcaucugccuguga

SEQ ID NO: 89223 - RNA, 1755 nt, Artificial Sequence; identical to SEQ ID NO: 87862
  derived and/or modified sequence opt1 from hemagglutinin__InfluenzaB__AHM01272

SEQ ID NO: 89224 - RNA, 1758 nt, Artificial Sequence; identical to SEQ ID NO: 89211
  derived and/or modified sequence opt1 from hemagglutinin__InfluenzaB__AHM01283

SEQ ID NO: 89225 - RNA, 1758 nt, Artificial Sequence; identical to SEQ ID NO: 89211
  derived and/or modified sequence opt1 from hemagglutinin__InfluenzaB__AHM01294

SEQ ID NO: 89226 - RNA, 1755 nt, Artificial Sequence; identical to SEQ ID NO: 87862
  derived and/or modified sequence opt1 from hemagglutinin__InfluenzaB__AHM01305

SEQ ID NO: 89227 - RNA, 1758 nt, Artificial Sequence; identical to SEQ ID NO: 87895
  derived and/or modified sequence opt1 from hemagglutinin__InfluenzaB__AHM01316

SEQ ID NO: 89228 - RNA, 1758 nt, Artificial Sequence; identical to SEQ ID NO: 89211
  derived and/or modified sequence opt1 from hemagglutinin__InfluenzaB__AHM01327

SEQ ID NO: 89229 - RNA, 1758 nt, Artificial Sequence; identical to SEQ ID NO: 87895
  derived and/or modified sequence opt1 from hemagglutinin__InfluenzaB__AHM01338

SEQ ID NO: 89230 - RNA, 1758 nt, Artificial Sequence; identical to SEQ ID NO: 87895
  derived and/or modified sequence opt1 from hemagglutinin__InfluenzaB__AHM01349

SEQ ID NO: 89231 - RNA, 1758 nt, Artificial Sequence
  derived and/or modified sequence opt1 from hemagglutinin__InfluenzaB__AHM01360
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccaagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89232 - RNA, 1755 nt, Artificial Sequence
  derived and/or modified sequence opt1 from hemagglutinin__InfluenzaB__AHM01371
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagaacggcuucuucgcgaccauggccugggccguccccaaggacaacaacaagaacgccaccaacccccugacgguggaggugccguacaucugcgccgagggcgaggaccagaucgcggucuggggguuccacagcgacaacaagacccagaugaagaaccuguacggcgacuccaacccccagaaguucaccagcuccgccaacggggugaccacgcacuacgugagccagaucggcggcuuccccgaccagaccgaggacgggggccucccccaguccgggcggaucgucguggacuacaugaugcagaagccgggcaagaccgggaccaucguguaccagcgcggcguccugcugccccagaagguguggugcgccagcggccgguccaaggugaucaaggggagccucccccugaucggcgaggccgacugccugcacgagaaguacgggggccucaacaagagcaagcccuacuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccucccacggcgcccacgggguggccgucgccgccgaccucaagagcacccaggaggcgaucaacaagaucaccaagaaccugaacucccugagcgagcucgaggugaagaaccugcagcgccuguccggcgccauggacgagcuccacaacgagauccuggagcuggacgagaagguggacgaccuccgggccgacaccaucagcucccagaucgagcuggccguccugcucagcaacgagggcaucaucaacuccgaggacgagcaccuccuggcgcuggagcgcaagcugaagaagaugcuggggcccagcgccguggacaucggcaacgggugcuucgagaccaagcacaagugcaaccagacgugccucgaccggaucgccgccggcaccuucaacgccggggaguucucccugcccaccuucgacagccugaacaucaccgcggccucccucaacgacgacggccuggacaaccacaccauccugcuguacuacagcacggccgccuccagccucgccgugacccugaugcuggcgaucuucaucgucuacauggugucccgcgacaacgugagcugcuccaucugccucuga

SEQ ID NO: 89233 - RNA, 1755 nt, Artificial Sequence; identical to SEQ ID NO: 87862
  derived and/or modified sequence opt1 from hemagglutinin__InfluenzaB__AHM01382

SEQ ID NO: 89234 - RNA, 1758 nt, Artificial Sequence
  derived and/or modified sequence opt1 from hemagglutinin__InfluenzaB__AHM01393
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgugacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89235 - RNA, 1758 nt, Artificial Sequence; identical to SEQ ID NO: 87895
  derived and/or modified sequence opt1 from hemagglutinin__InfluenzaB__AHM01404

SEQ ID NO: 89236 - RNA, 1758 nt, Artificial Sequence
  derived and/or modified sequence opt1 from hemagglutinin__InfluenzaB__AHM01415
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucaucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89237 - RNA, 1758 nt, Artificial Sequence
  derived and/or modified sequence opt1 from hemagglutinin__InfluenzaB__AHM01426
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccaucuggggcuuccacuccgacaacgagacccagauggccaagcuguacggggacagcaacccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89238 - RNA, 1755 nt, Artificial Sequence
  derived and/or modified sequence opt1 from hemagglutinin__InfluenzaB__AHM01437
augaaggccgugaucguccugcucaugguggugaccagcaacgccgaccgcaucugcaccggcaucacguccagcaacagcccccacgucgugaagaccgcgacccagggggaggugaacgucaccggcgugaucccgcugacgaccacccccaccaaguccuacuucgccaaccugaaggggacgaagacccggggcaagcucugccccgacugccugaacugcaccgaccuggacguggcccucgggcgccccaugugcgucggcaccacgccguccgccaaggccagcauccugcacgaggugcggcccgugaccuccggcugcuuccccaucaugcacgaccgcaccaagauccggcagcuggcgaaccuccugcgcggguacgagaacauccggcugagcacccagaacgucaucgacgccgagaaggcccccggcgggccguaccgccucggcacguccgggagcugccccaacgccaccuccaagagcggcuucuucgcgaccauggccugggccgugcccaaggacaacaacaagaacgccaccaacccccugacgguggaggucccguacaucugcgccgaggaggaggaccagaucaccguguggggcuuccacuccgacaacaagacccagaugaagaaccuguacggggacagcaacccccagaaguucaccuccagcgcgaacggcgugacgacccacuacgucucccagaucgggggcuuccccgaccagaccgaggacggcgggcucccccagagcggccggaucgugguggacuacaugaugcagaagccggggaagaccggcacgaucgucuaccagcgcggggugcugcugccccagaagguguggugcgccuccggccggagcaaggucaucaagggcagccucccccugaucggggaggccgacugccugcacgagaaguacggcgggcucaacaaguccaagcccuacuacaccggcgagcacgccaaggccaucgggaacugcccgaucugggugaagacgccccugaagcuggcgaacggcaccaaguaccgcccgcccgccaagcuccugaaggagcggggcuucuucggggccaucgccggcuuccuggagggcgggugggaggggaugaucgccggcuggcacggcuacaccagccacggggcgcacggcgucgccguggccgccgaccucaaguccacccaggaggccaucaacaagaucaccaagaaccugaacagccuguccgagcucgaggugaagaaccugcagcgccugagcggggcgauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcccuggagcgcaagcugaagaagaugcugggccccuccgcgguggacaucgggaacggcugcuucgagacgaagcacaagugcaaccagaccugccucgaccggaucgccgccgggaccuucaacgccggcgaguucagccugcccaccuucgacucccugaacaucaccgccgcgagccucaacgacgacgggcuggacaaccacacgauccugcuguacuacuccaccgccgccagcucccucgccgucacccugaugcuggccaucuucaucguguacauggugagccgcgacaacgucuccugcagcaucugccucuga

SEQ ID NO: 89239 - RNA, 1755 nt, Artificial Sequence
  derived and/or modified sequence opt1 from hemagglutinin__InfluenzaB__AHM01448
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacggccgaggugccguacaucugcgcggagggcgaggaccagaucaccguguggggguuccacuccgacaacaagacccagaugaagaaccuguacggcgacagcaacccccagaaguucaccuccagcgccaacggggucacgacccacuacgugucccagaucggcggcuuccccgaccagaccgaggacgggggccucccccagagcgggcggaucguggucgacuacaugaugcagaagccgggcaagaccgggacgaucguguaccagcgcggcgugcugcugccccagaaggucuggugcgccuccggccggagcaaggugaucaaggggagccucccccugaucggcgaggccgacugccugcacgagaaguacgggggccucaacaaguccaagcccuacuacaccggggagcacgccaaggcgaucggcaacugcccgaucugggugaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagccacggcgcccacggggucgccguggccgccgaccucaaguccacccaggaggcgaucaacaagaucaccaagaaccugaacagccuguccgagcucgaggucaagaaccugcagcgccugagcggcgccauggacgagcuccacaacgagauccuggagcuggacgagaagguggacgaccuccgggccgacaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaacgggugcuucgagacgaagcacaagugcaaccagaccugccucgaccggaucgccgccggcaccuucaacgccggggaguucagccugcccaccuucgacucccugaacaucaccgcggccagccucaacgacgacggccuggacaaccacacgauccugcuguacuacuccaccgccgccagcucccucgccgugacccugaugcuggcgaucuucaucguguacauggucagccgcgacaacguguccugcagcaucugccucuga

SEQ ID NO: 89240 - RNA, 1758 nt, Artificial Sequence; identical to SEQ ID NO: 87653
  derived and/or modified sequence opt1 from hemagglutinin__InfluenzaB__AHM01459

SEQ ID NO: 89241 - RNA, 1755 nt, Artificial Sequence
  derived and/or modified sequence opt1 from hemagglutinin__InfluenzaB__AHM01470
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucgccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccgugaacaagaucaccaagaaccugaacagccuguccgagcucgaggugaagaaccugcagcgccugagcggcgcgauggacgagcuccacaacgagauccuggagcuggacgagaaggucgacgaccuccgggccgacaccaucuccagccagaucgagcuggccgugcugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgucacccugaugcuggccaucuucaucguguacauggugagccgcgacaacgucuccugcagcaucugccucuga

SEQ ID NO: 89242 - RNA, 1755 nt, Artificial Sequence
  derived and/or modified sequence opt1 from hemagglutinin__InfluenzaB__AHM01481
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagcggguguggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagacgaagcacaagugcaaccagaccugccucgaccgcaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgggacaacguguccugcagcaucugccucuga

SEQ ID NO: 89243 - RNA, 1755 nt, Artificial Sequence; identical to SEQ ID NO: 87907
  derived and/or modified sequence opt1 from hemagglutinin__InfluenzaB__AHM01492

SEQ ID NO: 89244 - RNA, 1755 nt, Artificial Sequence; identical to SEQ ID NO: 87862
  derived and/or modified sequence opt1 from hemagglutinin__InfluenzaB__AHM01503

SEQ ID NO: 89245 - RNA, 1755 nt, Artificial Sequence; identical to SEQ ID NO: 87862
  derived and/or modified sequence opt1 from hemagglutinin__InfluenzaB__AHM01514

SEQ ID NO: 89246 - RNA, 1755 nt, Artificial Sequence
  derived and/or modified sequence opt1 from hemagglutinin__InfluenzaB__AHM01525
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugauccagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 89247 - RNA, 1755 nt, Artificial Sequence
  derived and/or modified sequence opt1 from hemagglutinin__InfluenzaB__AHM01536
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgugcacggggucgcgguggccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaaggucgacgaccuccgggcggacaccaucuccagccagaucgagcuggccgugcugcucuccaacgagggcaucaucaacagcgaggacgagcaccuccuggcccuggagcgcaagcugaagaagaugcuggggcccuccgccguggacaucggcaacgggugcuucgagacgaagcacaagugcaaccagaccugccucgaccggaucgcggccggcaccuucaacgccggggaguucagccugcccaccuucgacucccugaacaucaccgccgccagccucaacgacgacggccuggacaaccacacgauccugcuguacuacuccaccgcggccagcucccucgccgucacccugaugcuggccaucuucaucguguacauggugagccgcgacaacgucuccugcagcaucugccucuga

SEQ ID NO: 89248 - RNA, 1755 nt, Artificial Sequence; identical to SEQ ID NO: 87862
  derived and/or modified sequence opt1 from hemagglutinin__InfluenzaB__AHM01547

SEQ ID NO: 89249 - RNA, 1755 nt, Artificial Sequence; identical to SEQ ID NO: 87907
  derived and/or modified sequence opt1 from hemagglutinin__InfluenzaB__AHM01558

SEQ ID NO: 89250 - RNA, 1758 nt, Artificial Sequence; identical to SEQ ID NO: 87748
  derived and/or modified sequence opt1 from hemagglutinin__InfluenzaB__AHV83951

SEQ ID NO: 89251 - RNA, 1755 nt, Artificial Sequence; identical to SEQ ID NO: 89137
  derived and/or modified sequence opt1 from hemagglutinin__InfluenzaB__AHV83952

SEQ ID NO: 89252 - RNA, 1758 nt, Artificial Sequence; identical to SEQ ID NO: 87691
  derived and/or modified sequence opt1 from hemagglutinin__InfluenzaB__AHZ36697

SEQ ID NO: 89253 - RNA, 1758 nt, Artificial Sequence
  derived and/or modified sequence opt1 from hemagglutinin__InfluenzaB__AHZ36708
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccucaacgucacgaacggcaacggcuucuucgccaccauggccugggccgugcccaagaacgacaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcucccccagagcggccggaucgucguggacuacauggugcagaaguccgggaagacgggcaccaucaccuaccagcgcggcauccugcugccgcagaaggucuggugcaccagcgggcgguccaaggugaucaagggcagccucccccugaucggggaggccgacugccugcacgagaaguacggcgggcucaacaagagcaagcccuacuacacgggcgagcacgccaaggcgaucggcaacugccccaucugggugaagaccccgcugaagcuggccaacgggaccaaguaccgcccgcccgccaagcuccugaaggagcggggcuucuucggggccaucgccggcuuccuggagggcgggugggagggcaugaucgcgggguggcacggcuacaccucccacggggcccacggcgucgccguggccgccgaccucaagagcacgcaggaggcgaucaacaagaucaccaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcccuggagcgcaagcugaagaagaugcugggccccagcgcggucgagaucgggaacggcugcuucgagaccaagcacaagugcaaccagaccugccucgaccggaucgccgccgggacguucgacgccggcgaguucucccugcccaccuucgacagccugaacaucaccgcggccucccucaacgacgacggccuggacaaccacaccauccugcuguacuacagcacggccgccuccagccucgccgugacccugaugaucgcgaucuucguggucuacauggugucccgcgacaacgugagcugcuccaucugccuguga

SEQ ID NO: 89254 - RNA, 1758 nt, Artificial Sequence
  derived and/or modified sequence opt1 from hemagglutinin__InfluenzaB__AHZ36719
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacgucugcaccgagggggaggaccagaucaccguguggggcuuccacuccgacaacgagacccagauggccaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucgucguguacauggugucccgcgacaacgucagcugcuccaucugccuguga

SEQ ID NO: 89255 - RNA, 1758 nt, Artificial Sequence; identical to SEQ ID NO: 87691
  derived and/or modified sequence opt1 from hemagglutinin__InfluenzaB__AHZ36730

SEQ ID NO: 89256 - RNA, 1758 nt, Artificial Sequence; identical to SEQ ID NO: 87691
  derived and/or modified sequence opt1 from hemagglutinin__InfluenzaB__AHZ36752

SEQ ID NO: 89257 - RNA, 1758 nt, Artificial Sequence; identical to SEQ ID NO: 87653
  derived and/or modified sequence opt1 from hemagglutinin__InfluenzaB__AHZ36763

SEQ ID NO: 89258 - RNA, 1758 nt, Artificial Sequence
  derived and/or modified sequence opt1 from hemagglutinin__InfluenzaB__AHZ36774
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgaguccgcgcccggcgggcccuacaagaucggcaccagcggguccugccccaacgucacgaacggcaacggcuucuucgccaccauggccugggccgugccgaagaacgacaagaacaagaccgcgaccgacccccugacgaucgaggugcccuacaucugcaccgaggaggaggaccagaucaccgucuggggguuccacagcgacaacgagacccagauggccaagcucuacggcgacuccaagccccagaaguucacgagcuccgccaacggggugaccacccacuacgugagccagaucggcggcuucccgaaccagaccgaggacgggggccugccccaguccgggcggaucgucguggacuacauggugcagaaguccggcaagacggggaccaucaccuaccagcgcggcauccugcucccccagaaggucuggugcgccuccggccggagcaaggugaucaaggggagccugccccugaucggcgaggccgacugccuccacgagaaguacgggggccugaacaaguccaagccguacuacaccggggagcacgcgaaggccaucggcaacugccccaucugggugaagacgccccugaagcucgccaacggcaccaaguaccggcccccggccaagcugcugaaggagcgcggguucuucggcgccaucgcgggguuccucgagggcgggugggagggcaugaucgccggcuggcacggguacaccagccacggcgcccacggggucgccguggccgcggaccugaaguccacccaggaggccaucaacaaggucacgaagaaccugaacagccucuccgagcuggaggugaagaaccugcagcgccucagcggcgccauggacgagcugcacaacgagauccuggagcucgacgagaagguggacgaccugcgggccgacaccaucuccagccagaucgagcuggccguccuccuguccaacgagggcaucaucaacagcgaggacgagcaccuccuggcgcuggagcgcaagcugaagaagaugcucgggcccuccgccguggagaucggcaacgggugcuucgagaccaagcacaagugcaaccagaccugccuggaccggaucgccgccggcaccuucgacgcgggggaguucagccugcccacguucgacucccucaacaucaccgccgccagccugaacgacgacggccuggacaaccacaccauccuccuguacuacuccaccgccgccagcucccuggcggugacgcugaugaucgccaucuucgucguguacauggugagccgcgacaacgucuccugcagcaucugccucuga

SEQ ID NO: 89259 - RNA, 1758 nt, Artificial Sequence; identical to SEQ ID NO: 89167
  derived and/or modified sequence opt1 from hemagglutinin__InfluenzaB__AHZ36785

SEQ ID NO: 89260 - RNA, 1758 nt, Artificial Sequence; identical to SEQ ID NO: 89167
  derived and/or modified sequence opt1 from hemagglutinin__InfluenzaB__AHZ36796

SEQ ID NO: 89261 - RNA, 1755 nt, Artificial Sequence
  derived and/or modified sequence opt1 from hemagglutinin__InfluenzaB__AHZ36807
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccggagaagaccggcacgaucguguaccagcgcgggguccugcugccccagaagguguggugcgccuccggccggagcaaggugaucaagggcagccucccccugaucggggaggccgacugccugcacgagaaguacggcgggcucaacaaguccaagcccuacuacaccggcgagcacgccaaggccaucgggaacugcccgaucugggucaagacgccccugaagcuggcgaacggcaccaaguaccgcccgcccgccaagcuccugaaggagcggggcuucuucggggccaucgccggcuuccuggagggcgggugggaggggaugaucgccggcuggcacggcuacaccagccacggggcgcacggcguggccgucgccgccgaccucaaguccacccaggaggccaucaacaagaucaccaagaaccugaacagccuguccgagcucgaggugaagaaccugcagcgccugagcggggcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcugggccccuccgcgguggacaucgggaacggcugcuucgagacgaagcacaagugcaaccagaccugccucgaccggaucgccgccgggaccuucaacgccggcgaguucagccugcccaccuucgacucccugaacaucaccgccgcgagccucaacgacgacgggcuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 89262 - RNA, 1758 nt, Artificial Sequence; identical to SEQ ID NO: 87691
  derived and/or modified sequence opt1 from hemagglutinin__InfluenzaB__AHZ36818

SEQ ID NO: 89263 - RNA, 1758 nt, Artificial Sequence; identical to SEQ ID NO: 87653
  derived and/or modified sequence opt1 from hemagglutinin__InfluenzaB__AHZ36829

SEQ ID NO: 89264 - RNA, 1758 nt, Artificial Sequence; identical to SEQ ID NO: 87653
  derived and/or modified sequence opt1 from hemagglutinin__InfluenzaB__AHZ36840

SEQ ID NO: 89265 - RNA, 1758 nt, Artificial Sequence; identical to SEQ ID NO: 89167
  derived and/or modified sequence opt1 from hemagglutinin__InfluenzaB__AHZ36851

SEQ ID NO: 89266 - RNA, 1758 nt, Artificial Sequence; identical to SEQ ID NO: 87691
  derived and/or modified sequence opt1 from hemagglutinin__InfluenzaB__AHZ36862

SEQ ID NO: 89267 - RNA, 1758 nt, Artificial Sequence; identical to SEQ ID NO: 87653
  derived and/or modified sequence opt1 from hemagglutinin__InfluenzaB__AHZ36873

SEQ ID NO: 89268 - RNA, 1758 nt, Artificial Sequence
  derived and/or modified sequence opt1 from hemagglutinin__InfluenzaB__AHZ36884
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgagaccauggccugggccgugcccaagaacgacaagaacaagaccgccaccaacccgcucacgaucgagguccccuacaucugcaccgagggggaggaccagaucaccguguggggcuuccacuccgacaacgagacccagauggcgaagcuguacggggacagcaagccccagaaguucacguccagcgccaacggcgugaccacccacuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccguccugcugagcaacgaggggaucaucaacuccgaggacgagcaccuccuggcccuggagcgcaagcucaagaagaugcugggccccagcgcgguggagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucgucguguacauggugucccgcgacaacgucagcugcuccaucugccuguga

SEQ ID NO: 89269 - RNA, 1758 nt, Artificial Sequence; identical to SEQ ID NO: 87691
  derived and/or modified sequence opt1 from hemagglutinin__InfluenzaB__AHZ36895

SEQ ID NO: 89270 - RNA, 1758 nt, Artificial Sequence; identical to SEQ ID NO: 87691
  derived and/or modified sequence opt1 from hemagglutinin__InfluenzaB__AHZ36906

SEQ ID NO: 89271 - RNA, 1758 nt, Artificial Sequence
  derived and/or modified sequence opt1 from hemagglutinin__InfluenzaB__AHZ36928
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgaagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccucaacgucacgaacggcaacggcuucuucgccaccauggccugggccgugcccaagaacgacaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcucccccagagcggccggaucgucguggacuacauggugcagaaguccgggaagacgggcaccaucaccuaccagcgcggcauccugcugccgcagaaggucuggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugccccaucugggugaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugccucgaccggaucgccgccgggaccuucgacgcgggcgaguucucccugcccacguucgacagccugaacaucaccgccgccucccucaacgacgacggccuggacaaccacaccauccugcuguacuacagcaccgccgccuccagccucgcggugacgcugaugaucgccaucuucguggucuacauggugucccgcgacaacgugagcugcuccaucugccuguga

SEQ ID NO: 89272 - RNA, 1758 nt, Artificial Sequence; identical to SEQ ID NO: 89167
  derived and/or modified sequence opt1 from hemagglutinin__InfluenzaB__AHZ36939

SEQ ID NO: 89273 - RNA, 1758 nt, Artificial Sequence
  derived and/or modified sequence opt1 from hemagglutinin__InfluenzaB__AHZ36950
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccaucacguccggcugcuuccccaucaugcacgaccggaccaagauccgccagcugcccaaccuccugcggggguacgagcacauccgccugagcacccacaacgucaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89274 - RNA, 1758 nt, Artificial Sequence
  derived and/or modified sequence opt1 from hemagglutinin__InfluenzaB__AHZ36961
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggggcuccaaggugaucaaggggagccugccccucaucggcgaggccgacugccugcacgagaaguacgggggccugaacaagagcaagcccuacuacaccggcgagcacgcgaaggccaucgggaacugcccgaucugggugaagacgccccucaagcuggccaacggcaccaaguaccggccgcccgccaagcugcucaaggagcgcggguucuucggcgccaucgcgggguuccuggagggcggcugggaggggaugaucgccggcuggcacggguacaccucccacggcgcccacggcgucgccguggccgcggaccugaaguccacccaggaggccaucaacaagaucacgaagaaccucaacucccugagcgagcuggaggucaagaaccuccagcggcuguccggggccauggacgagcugcacaacgagauccucgagcuggacgagaagguggacgaccugcgcgccgacaccaucagcucccagaucgagcucgccgugcugcugagcaacgagggcaucaucaacuccgaggacgagcaccuccuggcgcuggagcggaagcucaagaagaugcuggggcccagcgccgucgagaucggcaacgggugcuucgagaccaagcacaagugcaaccagaccugccuggaccgcaucgccgccggcaccuucgacgcgggcgaguucucccuccccacguucgacagccugaacaucaccgccgccucccugaacgacgacgggcucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 89275 - RNA, 1758 nt, Artificial Sequence; identical to SEQ ID NO: 87691
  derived and/or modified sequence opt1 from hemagglutinin__InfluenzaB__AHZ36972

SEQ ID NO: 89276 - RNA, 1758 nt, Artificial Sequence
  derived and/or modified sequence opt1 from hemagglutinin__InfluenzaB__AHZ36983
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagcgccaacggcgugaccgcccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccagcgggcgguccaaggugaucaagggcagccugccccucaucggggaggcggacugccugcacgagaaguacggcgggcugaacaagagcaagcccuacuacaccggcgagcacgccaaggccaucggcaacugcccgaucugggucaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccguggcggccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgcgguccugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgugacccucaugaucgccaucuucgucguguacauggugucccgcgacaacgucagcugcuccaucugccuguga

SEQ ID NO: 89277 - RNA, 1758 nt, Artificial Sequence
  derived and/or modified sequence opt1 from hemagglutinin__InfluenzaB__AHZ37005
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgaguccgcgcccggcgggcccuacaagaucggcaccagcggguccugccccaacgucacgaacggcaacggcuucuucgccaccauggccugggccgugccgaagaacgacaagaacaagaccgcgaccgacccccugacgaucgaggugcccuacaucugcaccgaggaggaggaccagaucaccgucuggggguuccacagcgacaacgagacccagauggccaagcucuacggcgacuccaagccccagaaguucacgagcuccgccaacggggugaccacccacuacgugagccagaucggcggcuucccgaaccagaccgaggacgggggccugccccaguccgggcggaucgucguggacuacauggugcagaaguccggcaagacggggaccaucaccuaccagcgcggcauccugcucccccagaaggucuggugcgccuccggccggagcaaggugaucaaggggagccugccccugaucggcgaggccgacugccuccacgagaaguacgggggccugaacaaguccaagccguacuacaccggggagcacgcgaaggccaucggcaacugccccaucugggugaagacgccccugaagcucgccaacggcaccaaguaccggcccccggccaagcugcugaaggagcgcggguucuucggcgccaucgcgggguuccucgagggcgggugggagggcaugaucgccggcuggcacggguacaccagccacggcgcccacggggucgccguggccgcggaccugaaguccacccaggaggccaucaacaagaucacgaagaaccugaacagccucuccgagcuggaggucaagaaccugcagcgccucagcggcgccauggacgagcugcacaacgagauccuggagcucgacgagaagguggacgaccugcgggccgacaccaucuccagccagaucgagcuggccgugcuccuguccaacgagggcaucaucaacagcgaggacgagcaccuccuggcgcuggagcgcaagcugaagaagaugcucgggcccuccgccgucgagaucggcaacgggugcuucgagaccaagcacaagugcaaccagaccugccuggaccggaucgccgccggcaccuucgacgcgggggaguucagccugcccacguucgacucccucaacaucaccgccgccagccugaacgacgacggccuggacaaccacaccauccuccuguacuacuccaccgccgccagcucccuggcggugacgcugaugaucgccaucuucguggucuacauggugagccgcgacaacguguccugcagcaucugccucuga

SEQ ID NO: 89278 - RNA, 1758 nt, Artificial Sequence; identical to SEQ ID NO: 87653
  derived and/or modified sequence opt1 from hemagglutinin__InfluenzaB__AHZ37016

SEQ ID NO: 89279 - RNA, 1758 nt, Artificial Sequence
  derived and/or modified sequence opt1 from hemagglutinin__InfluenzaB__AHZ37027
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcaucauccacgagguccgccccgugacguccggcugcuuccccaucaugcacgaccggaccaagauccgccagcugcccaaccugcuccggggguacgagcacauccgccugagcacccacaacgugaucaacgccgagaacgcgccgggcgggcccuacaagaucggcaccuccgggagcugccugaacgucacgaacggcaacggcuucuucgccaccauggccugggccgugcccaagaacgacaagaacaagaccgcgaccaacccccucacgaucgaggugccguacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89280 - RNA, 1758 nt, Artificial Sequence; identical to SEQ ID NO: 87653
  derived and/or modified sequence opt1 from hemagglutinin__InfluenzaB__AHZ37038

SEQ ID NO: 89281 - RNA, 1758 nt, Artificial Sequence; identical to SEQ ID NO: 89167
  derived and/or modified sequence opt1 from hemagglutinin__InfluenzaB__AHZ37049

SEQ ID NO: 89282 - RNA, 1758 nt, Artificial Sequence; identical to SEQ ID NO: 89167
  derived and/or modified sequence opt1 from hemagglutinin__InfluenzaB__AHZ37060

SEQ ID NO: 89283 - RNA, 1758 nt, Artificial Sequence; identical to SEQ ID NO: 87653
  derived and/or modified sequence opt1 from hemagglutinin__InfluenzaB__AHZ37071

SEQ ID NO: 89284 - RNA, 1758 nt, Artificial Sequence; identical to SEQ ID NO: 87653
  derived and/or modified sequence opt1 from hemagglutinin__InfluenzaB__AHZ37082

SEQ ID NO: 89285 - RNA, 1758 nt, Artificial Sequence; identical to SEQ ID NO: 89167
  derived and/or modified sequence opt1 from hemagglutinin__InfluenzaB__AHZ37093

SEQ ID NO: 89286 - RNA, 1758 nt, Artificial Sequence
  derived and/or modified sequence opt1 from hemagglutinin__InfluenzaB__AHZ37104
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggaccacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89287 - RNA, 1758 nt, Artificial Sequence
  derived and/or modified sequence opt1 from hemagglutinin__InfluenzaB__AHZ41770
augaaggccaucaucgugcugcucauggucgugaccagcaacgccgaccgcaucugcaccggcaucacguccagcaacagcccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccgugcccaagaacgacaagaacaagaccgcgaucaacccgcucaccaucgagguccccuacaucugcacggagggggaggaccagaucaccguguggggcuuccacuccgacaacgagacccagauggccaagcuguacggggacagcgagccccagaaguucaccuccagcgccaacggcgugacgacccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccguccugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucgucguguacauggugucccgcgacaacgucagcugcuccaucugccuguga

SEQ ID NO: 89288 - RNA, 1758 nt, Artificial Sequence; identical to SEQ ID NO: 87691
  derived and/or modified sequence opt1 from hemagglutinin__InfluenzaB__AHZ41781

SEQ ID NO: 89289 - RNA, 1758 nt, Artificial Sequence; identical to SEQ ID NO: 87691
  derived and/or modified sequence opt1 from hemagglutinin__InfluenzaB__AHZ41792

SEQ ID NO: 89290 - RNA, 1758 nt, Artificial Sequence; identical to SEQ ID NO: 87691
  derived and/or modified sequence opt1 from hemagglutinin__InfluenzaB__AHZ41803

SEQ ID NO: 89291 - RNA, 1758 nt, Artificial Sequence
  derived and/or modified sequence opt1 from hemagglutinin__InfluenzaB__AHZ41814
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccgucaccuaccagcgcggcauccugcucccccagaagguguggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggucaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcguggccgucgccgcggaccugaaguccacccaggaggccaucaacaagaucacgaagaaccugaacucccucagcgagcuggaggugaagaaccugcagcgccucuccggcgccauggacgagcugcacaacgagauccuggagcucgacgagaagguggacgaccugcgggccgacaccaucagcucccagaucgagcuggccguccuccugagcaacgaggggaucaucaacuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucgucguguacauggugucccgcgacaacgucagcugcuccaucugccucuga

SEQ ID NO: 89292 - RNA, 1758 nt, Artificial Sequence; identical to SEQ ID NO: 87691
  derived and/or modified sequence opt1 from hemagglutinin__InfluenzaB__AHZ41825

SEQ ID NO: 89293 - RNA, 1758 nt, Artificial Sequence; identical to SEQ ID NO: 87691
  derived and/or modified sequence opt1 from hemagglutinin__InfluenzaB__AHZ41836

SEQ ID NO: 89294 - RNA, 1758 nt, Artificial Sequence; identical to SEQ ID NO: 87691
  derived and/or modified sequence opt1 from hemagglutinin__InfluenzaB__AHZ41847

SEQ ID NO: 89295 - RNA, 1755 nt, Artificial Sequence; identical to SEQ ID NO: 89139
  derived and/or modified sequence opt1 from hemagglutinin__InfluenzaB__AHZ41858

SEQ ID NO: 89296 - RNA, 1758 nt, Artificial Sequence; identical to SEQ ID NO: 89164
  derived and/or modified sequence opt1 from hemagglutinin__InfluenzaB__AHZ41869

SEQ ID NO: 89297 - RNA, 1755 nt, Artificial Sequence
  derived and/or modified sequence opt1 from hemagglutinin__InfluenzaB__AIC73844
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgggacaacguguccugcagcaucugccuguga

SEQ ID NO: 89298 - RNA, 1758 nt, Artificial Sequence; identical to SEQ ID NO: 88873
  derived and/or modified sequence opt1 from hemagglutinin__InfluenzaB__AIC73845

SEQ ID NO: 89299 - RNA, 1758 nt, Artificial Sequence; identical to SEQ ID NO: 88873
  derived and/or modified sequence opt1 from hemagglutinin__InfluenzaB__AIC73846

SEQ ID NO: 89300 - RNA, 1758 nt, Artificial Sequence
  derived and/or modified sequence opt1 from hemagglutinin__InfluenzaB__AIC73847
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccuggacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89301 - RNA, 1758 nt, Artificial Sequence; identical to SEQ ID NO: 88873
  derived and/or modified sequence opt1 from hemagglutinin__InfluenzaB__AIC73848

SEQ ID NO: 89302 - RNA, 1755 nt, Artificial Sequence; identical to SEQ ID NO: 89137
  derived and/or modified sequence opt1 from hemagglutinin__InfluenzaB__AIC73849

SEQ ID NO: 89303 - RNA, 1758 nt, Artificial Sequence
  derived and/or modified sequence opt1 from hemagglutinin__InfluenzaB__AIC73850
augaaggccaucaucgugcugcucauggucgccaccagcaacgcggaccgcaucugcaccggcaucacguccagcaacagcccccacguggugaagaccgccacccagggggaggucaacgugaccggcgugaucccgcugacgaccacccccaccaagagccacuucgccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcacauccgccugagcacccacaacgugaucaacgcggaggacgccccgggcgggcccuacaagaucggcaccuccgggagcugccccaacgugacgaacggcaacggcuucuucgccaccauggccugggcgguccccaagaacgacaagaacaagaccgccaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgcggugcugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccacguucgacagccugaacaucaccgccgccucccugaacgacgacggccucgacaaccacaccauccugcuguacuacagcaccgccgcguccagccuggccgucacgcucaugaucgccaucuucgugguguacauggucucccgcgacaacgugagcugcuccaucugccuguga

SEQ ID NO: 89304 - RNA, 1758 nt, Artificial Sequence; identical to SEQ ID NO: 87895
  derived and/or modified sequence opt1 from hemagglutinin__InfluenzaB__AIC73851

SEQ ID NO: 89305 - RNA, 1755 nt, Artificial Sequence; identical to SEQ ID NO: 89297
  derived and/or modified sequence opt1 from hemagglutinin__InfluenzaB__AIC73852

SEQ ID NO: 89306 - RNA, 1755 nt, Artificial Sequence; identical to SEQ ID NO: 89297
  derived and/or modified sequence opt1 from hemagglutinin__InfluenzaB__AIC73853

SEQ ID NO: 89307 - RNA, 1758 nt, Artificial Sequence
  derived and/or modified sequence opt1 from hemagglutinin__InfluenzaB__AIC73855
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaucaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89308 - RNA, 1758 nt, Artificial Sequence; identical to SEQ ID NO: 88873
  derived and/or modified sequence opt1 from hemagglutinin__InfluenzaB__AIC73856

SEQ ID NO: 89309 - RNA, 1758 nt, Artificial Sequence; identical to SEQ ID NO: 88873
  derived and/or modified sequence opt1 from hemagglutinin__InfluenzaB__AIC73857

SEQ ID NO: 89310 - RNA, 1758 nt, Artificial Sequence; identical to SEQ ID NO: 88873
  derived and/or modified sequence opt1 from hemagglutinin__InfluenzaB__AIC73859

SEQ ID NO: 89311 - RNA, 1758 nt, Artificial Sequence
  derived and/or modified sequence opt1 from hemagglutinin__InfluenzaB__AIC73860
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaugagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89312 - RNA, 1758 nt, Artificial Sequence
  derived and/or modified sequence opt1 from hemagglutinin__InfluenzaB__AIC73861
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacaccgagaacgccccgggcgggcccuacaagaucggcacguccgggagcugccccaacgucaccaacggcaacggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaacgagacgcagauggcgaagcuguacggggacagcaacccccagaaguucaccuccagcgccaacggcgugaccauccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 89313 - RNA, 1758 nt, Artificial Sequence; identical to SEQ ID NO: 89311
  derived and/or modified sequence opt1 from hemagglutinin__InfluenzaB__AIC73862

SEQ ID NO: 89314 - RNA, 1758 nt, Artificial Sequence; identical to SEQ ID NO: 89311
  derived and/or modified sequence opt1 from hemagglutinin__InfluenzaB__AIC73863

SEQ ID NO: 89315 - RNA, 1758 nt, Artificial Sequence; identical to SEQ ID NO: 89311
  derived and/or modified sequence opt1 from hemagglutinin__InfluenzaB__AIC73864

SEQ ID NO: 89316 - RNA, 1755 nt, Artificial Sequence
  derived and/or modified sequence opt1 from hemagglutinin__InfluenzaB__AIC73865
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagcgggaggacgggggccucccccagagcgggcgcaucgucguggacuacaugaugcagaagccgggcaagaccgggaccaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagaccaagcacaagugcaaccagacgugccucgaccgcaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacauggugagccgggacaacguguccugcagcaucugccucuga

SEQ ID NO: 89317 - RNA, 1758 nt, Artificial Sequence
  derived and/or modified sequence opt1 from hemagglutinin__InfluenzaB__AIC73867
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucgacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89318 - RNA, 1758 nt, Artificial Sequence; identical to SEQ ID NO: 87895
  derived and/or modified sequence opt1 from hemagglutinin__InfluenzaB__AIC73868

SEQ ID NO: 89319 - RNA, 1758 nt, Artificial Sequence; identical to SEQ ID NO: 89311
  derived and/or modified sequence opt1 from hemagglutinin__InfluenzaB__AIC73869

SEQ ID NO: 89320 - RNA, 1758 nt, Artificial Sequence; identical to SEQ ID NO: 89311
  derived and/or modified sequence opt1 from hemagglutinin__InfluenzaB__AIC73870

SEQ ID NO: 89321 - RNA, 1758 nt, Artificial Sequence; identical to SEQ ID NO: 88873
  derived and/or modified sequence opt1 from hemagglutinin__InfluenzaB__AIC73871

SEQ ID NO: 89322 - RNA, 1755 nt, Artificial Sequence; identical to SEQ ID NO: 89297
  derived and/or modified sequence opt1 from hemagglutinin__InfluenzaB__AIC73872

SEQ ID NO: 89323 - RNA, 1755 nt, Artificial Sequence; identical to SEQ ID NO: 89137
  derived and/or modified sequence opt1 from hemagglutinin__InfluenzaB__AIC73873

SEQ ID NO: 89324 - RNA, 1755 nt, Artificial Sequence; identical to SEQ ID NO: 89297
  derived and/or modified sequence opt1 from hemagglutinin__InfluenzaB__AIC73874

SEQ ID NO: 89325 - RNA, 1755 nt, Artificial Sequence; identical to SEQ ID NO: 89316
  derived and/or modified sequence opt1 from hemagglutinin__InfluenzaB__AIC73875

SEQ ID NO: 89326 - RNA, 1755 nt, Artificial Sequence
  derived and/or modified sequence opt1 from hemagglutinin__InfluenzaB__AIC73876
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacaacaagacccagaugaagaaccuguacggcgacagcaacccccagaaguucaccuccagcgcgaacggggugacgacccacuacgugucccagaucggcggcuuccccgaccagcgggaggacgggggccucccccagagcgggcgcaucgucguggacuacaugaugcagaagccgggcaagaccgggaccaucguguaccagcggggcguccugcugccccagaagguguggugcgccuccggccgcagcaaggugaucaaggggagccucccccugaucggcgaggccgacugccugcacgagaaguacgggggccucaacaaguccaagcccuacuacacgggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcggcugagcggcgcgauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgcgguggacaucggcaacgggugcuucgagaccaagcacaagugcaaccagacgugccucaaccgcaucgccgccggcaccuucaacgccggggaguucagccugcccaccuucgacucccugaacaucaccgccgcgagccucaacgacgacggccuggacaaccacaccauccugcuguacuacuccacggccgccagcucccucgccgugacccugaugcuggccaucuucaucgucuacauggugagccgggacaacguguccugcagcaucugccucuga

SEQ ID NO: 89327 - RNA, 1755 nt, Artificial Sequence; identical to SEQ ID NO: 89316
  derived and/or modified sequence opt1 from hemagglutinin__InfluenzaB__AIC73877

SEQ ID NO: 89328 - RNA, 1755 nt, Artificial Sequence; identical to SEQ ID NO: 89316
  derived and/or modified sequence opt1 from hemagglutinin__InfluenzaB__AIC73878

SEQ ID NO: 89329 - RNA, 1755 nt, Artificial Sequence; identical to SEQ ID NO: 89316
  derived and/or modified sequence opt1 from hemagglutinin__InfluenzaB__AIC73879

SEQ ID NO: 89330 - RNA, 1755 nt, Artificial Sequence; identical to SEQ ID NO: 89316
  derived and/or modified sequence opt1 from hemagglutinin__InfluenzaB__AIC73880

SEQ ID NO: 89331 - RNA, 1755 nt, Artificial Sequence; identical to SEQ ID NO: 89316
  derived and/or modified sequence opt1 from hemagglutinin__InfluenzaB__AIC73881

SEQ ID NO: 89332 - RNA, 1755 nt, Artificial Sequence; identical to SEQ ID NO: 89316
  derived and/or modified sequence opt1 from hemagglutinin__InfluenzaB__AIC73882

SEQ ID NO: 89333 - RNA, 1755 nt, Artificial Sequence; identical to SEQ ID NO: 89137
  derived and/or modified sequence opt1 from hemagglutinin__InfluenzaB__AIC73883

SEQ ID NO: 89334 - RNA, 1755 nt, Artificial Sequence; identical to SEQ ID NO: 89316
  derived and/or modified sequence opt1 from hemagglutinin__InfluenzaB__AIC73884

SEQ ID NO: 89335 - RNA, 1758 nt, Artificial Sequence
  derived and/or modified sequence opt1 from hemagglutinin__InfluenzaB__AIC73885
auggaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89336 - RNA, 1758 nt, Artificial Sequence; identical to SEQ ID NO: 88873
  derived and/or modified sequence opt1 from hemagglutinin__InfluenzaB__AIC73886

SEQ ID NO: 89337 - RNA, 1758 nt, Artificial Sequence; identical to SEQ ID NO: 89317
  derived and/or modified sequence opt1 from hemagglutinin__InfluenzaB__AIC73887

SEQ ID NO: 89338 - RNA, 1755 nt, Artificial Sequence; identical to SEQ ID NO: 89137
  derived and/or modified sequence opt1 from hemagglutinin__InfluenzaB__AIC73888

SEQ ID NO: 89339 - RNA, 1755 nt, Artificial Sequence; identical to SEQ ID NO: 89297
  derived and/or modified sequence opt1 from hemagglutinin__InfluenzaB__AIC73889

SEQ ID NO: 89340 - RNA, 1755 nt, Artificial Sequence; identical to SEQ ID NO: 89297
  derived and/or modified sequence opt1 from hemagglutinin__InfluenzaB__AIC73890

SEQ ID NO: 89341 - RNA, 1758 nt, Artificial Sequence
  derived and/or modified sequence opt1 from hemagglutinin__InfluenzaB__AIC73892
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgucccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 89342 - RNA, 1755 nt, Artificial Sequence; identical to SEQ ID NO: 89137
  derived and/or modified sequence opt1 from hemagglutinin__InfluenzaB__AIC73893

SEQ ID NO: 89343 - RNA, 1755 nt, Artificial Sequence; identical to SEQ ID NO: 89297
  derived and/or modified sequence opt1 from hemagglutinin__InfluenzaB__AIC73894

SEQ ID NO: 89344 - RNA, 1755 nt, Artificial Sequence; identical to SEQ ID NO: 89297
  derived and/or modified sequence opt1 from hemagglutinin__InfluenzaB__AIC73895

SEQ ID NO: 89345 - RNA, 1755 nt, Artificial Sequence; identical to SEQ ID NO: 89297
  derived and/or modified sequence opt1 from hemagglutinin__InfluenzaB__AIC73896

SEQ ID NO: 89346 - RNA, 1755 nt, Artificial Sequence; identical to SEQ ID NO: 89297
  derived and/or modified sequence opt1 from hemagglutinin__InfluenzaB__AIC73897

SEQ ID NO: 89347 - RNA, 1755 nt, Artificial Sequence; identical to SEQ ID NO: 89297
  derived and/or modified sequence opt1 from hemagglutinin__InfluenzaB__AIC73898

SEQ ID NO: 89348 - RNA, 1755 nt, Artificial Sequence; identical to SEQ ID NO: 89297
  derived and/or modified sequence opt1 from hemagglutinin__InfluenzaB__AIC73899

SEQ ID NO: 89349 - RNA, 1755 nt, Artificial Sequence; identical to SEQ ID NO: 89297
  derived and/or modified sequence opt1 from hemagglutinin__InfluenzaB__AIC73900

SEQ ID NO: 89350 - RNA, 1755 nt, Artificial Sequence; identical to SEQ ID NO: 89297
  derived and/or modified sequence opt1 from hemagglutinin__InfluenzaB__AIC73902

SEQ ID NO: 89351 - RNA, 1755 nt, Artificial Sequence
  derived and/or modified sequence opt1 from hemagglutinin__InfluenzaB__AIC73903
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacgggaucaccacccacuacgugucccagaucggcgacuuccccgaccagaccgaggacggcgggcugccgcagagcggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccgucgacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucguguacauggucagccgggacaacguguccugcagcaucugccuguga

SEQ ID NO: 89352 - RNA, 1755 nt, Artificial Sequence
  derived and/or modified sequence opt1 from hemagglutinin__InfluenzaB__AIC73904
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaucaccccguccgccaaggccagcauccugcacgagguccgccccgugacguccggcugcuuccccaucaugcacgaccggaccaagauccgccagcugcccaaccuccugcggggguacgagaagauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcagaccguggaggugcccuacaucugcacggagggcgaggaccagaucaccgucuggggguuccacagcgacaacaagacccagaugaagucccuguacggcgacagcaacccccagaaguucaccuccagcgccaacggggugacgacccacuacgugucccagaucggcgacuuccccgaccagaccgaggacggcgggcugccgcagagcggccgcaucgucguggacuacaugaugcagaagcccgggaagaccggcacgaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacaccaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagacgaagcacaagugcaaccagaccugccuggaccgcaucgccgcggggaccuucaacgccggcgaguucagccuccccaccuucgacucccugaacaucaccgccgccagccugaacgacgacgggcucgacaaccacacgauccugcuguacuacuccaccgccgcgagcucccuggccgugacccucaugcuggccaucuucaucgucuacauggugagccgggacaacguguccugcagcaucugccuguga

SEQ ID NO: 89353 - RNA, 1755 nt, Artificial Sequence; identical to SEQ ID NO: 89297
  derived and/or modified sequence opt1 from hemagglutinin__InfluenzaB__AIC73905

SEQ ID NO: 89354 - RNA, 1755 nt, Artificial Sequence; identical to SEQ ID NO: 89297
  derived and/or modified sequence opt1 from hemagglutinin__InfluenzaB__AIC73906

SEQ ID NO: 89355 - RNA, 1755 nt, Artificial Sequence; identical to SEQ ID NO: 89297
  derived and/or modified sequence opt1 from hemagglutinin__InfluenzaB__AIC73907

SEQ ID NO: 89356 - RNA, 1755 nt, Artificial Sequence; identical to SEQ ID NO: 89297
  derived and/or modified sequence opt1 from hemagglutinin__InfluenzaB__AIC73908

SEQ ID NO: 89357 - RNA, 1755 nt, Artificial Sequence; identical to SEQ ID NO: 89297
  derived and/or modified sequence opt1 from hemagglutinin__InfluenzaB__AIC73909

SEQ ID NO: 89358 - RNA, 1755 nt, Artificial Sequence; identical to SEQ ID NO: 89297
  derived and/or modified sequence opt1 from hemagglutinin__InfluenzaB__AIC73910

SEQ ID NO: 89359 - RNA, 1755 nt, Artificial Sequence; identical to SEQ ID NO: 89297
  derived and/or modified sequence opt1 from hemagglutinin__InfluenzaB__AIC73911

SEQ ID NO: 89360 - RNA, 1755 nt, Artificial Sequence; identical to SEQ ID NO: 89297
  derived and/or modified sequence opt1 from hemagglutinin__InfluenzaB__AIC73912

SEQ ID NO: 89361 - RNA, 1755 nt, Artificial Sequence; identical to SEQ ID NO: 89297
  derived and/or modified sequence opt1 from hemagglutinin__InfluenzaB__AIC73913

SEQ ID NO: 89362 - RNA, 1755 nt, Artificial Sequence; identical to SEQ ID NO: 89297
  derived and/or modified sequence opt1 from hemagglutinin__InfluenzaB__AIC73914

SEQ ID NO: 89363 - RNA, 1755 nt, Artificial Sequence; identical to SEQ ID NO: 89297
  derived and/or modified sequence opt1 from hemagglutinin__InfluenzaB__AIC73915

SEQ ID NO: 89364 - RNA, 1755 nt, Artificial Sequence; identical to SEQ ID NO: 89297
  derived and/or modified sequence opt1 from hemagglutinin__InfluenzaB__AIC73916

SEQ ID NO: 89365 - RNA, 1755 nt, Artificial Sequence; identical to SEQ ID NO: 89297
  derived and/or modified sequence opt1 from hemagglutinin__InfluenzaB__AIC73917

SEQ ID NO: 89366 - RNA, 1755 nt, Artificial Sequence; identical to SEQ ID NO: 89297
  derived and/or modified sequence opt1 from hemagglutinin__InfluenzaB__AIC73918

SEQ ID NO: 89367 - RNA, 1755 nt, Artificial Sequence; identical to SEQ ID NO: 89137
  derived and/or modified sequence opt1 from hemagglutinin__InfluenzaB__AIC73919

SEQ ID NO: 89368 - RNA, 1755 nt, Artificial Sequence; identical to SEQ ID NO: 89297
  derived and/or modified sequence opt1 from hemagglutinin__InfluenzaB__AIC73920

SEQ ID NO: 89369 - RNA, 1758 nt, Artificial Sequence; identical to SEQ ID NO: 88873
  derived and/or modified sequence opt1 from hemagglutinin__InfluenzaB__AIC73921

SEQ ID NO: 89370 - RNA, 1755 nt, Artificial Sequence; identical to SEQ ID NO: 89297
  derived and/or modified sequence opt1 from hemagglutinin__InfluenzaB__AIC73922

SEQ ID NO: 89371 - RNA, 1758 nt, Artificial Sequence; identical to SEQ ID NO: 87895
  derived and/or modified sequence opt1 from hemagglutinin__InfluenzaB__AIC73924

SEQ ID NO: 89372 - RNA, 1758 nt, Artificial Sequence
  derived and/or modified sequence opt1 from hemagglutinin__InfluenzaB__AIC73925
augaaggccaccaucgugcugcucauggucgugaccagcaacgccgaccgcaucugcacgggcaucaccuccagcaacagcccccacguggucaagaccgcgacccagggggaggugaacgugacgggcgucaucccgcugaccaccacccccaccaagagccacuucgccaaccugaaggggaccgagacccggggcaagcucugccccaagugccugaacugcaccgaccuggacguggcccucgggcgccccaagugcacgggcaagaucccguccgcccgggugagcauccugcacgagguccgccccgugaccuccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcacguccgggagcugccccaacgucaccaacggcaacggcuucuucgccaccauggccugggccgugcccaagaacgacaagaacaagaccgcgacgaacccgcucaccaucgaggugcccuacaucugcaccgagggggaggaccagaucaccgucuggggcuuccacuccgacaacgagacgcagauggccaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacgcaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcuccaucugccuguga

SEQ ID NO: 89373 - RNA, 1755 nt, Artificial Sequence; identical to SEQ ID NO: 89297
  derived and/or modified sequence opt1 from hemagglutinin__InfluenzaB__AIC73926

SEQ ID NO: 89374 - RNA, 1755 nt, Artificial Sequence; identical to SEQ ID NO: 87575
  derived and/or modified sequence opt1 from hemagglutinin__InfluenzaB__AIL94977

SEQ ID NO: 89375 - RNA, 1755 nt, Artificial Sequence; identical to SEQ ID NO: 87575
  derived and/or modified sequence opt1 from hemagglutinin__InfluenzaB__AIL94988

SEQ ID NO: 89376 - RNA, 1755 nt, Artificial Sequence
  derived and/or modified sequence opt1 from hemagglutinin__InfluenzaB__AIL94999
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaccggcuucuucgccaccauggcgugggccguccccaaggacaacuacaagaacgccacgaacccgcugaccguggaggugcccuacaucugcaccgagggcgaggaccagaucaccgucuggggguuccacagcgacaacaagacgcagaugaagaaccuguacggcgacuccaacccccagaaguucaccagcuccgccaacggggugaccacccacuacgugagccagaucggcgacuuccccgaccagacggaggacggcgggcucccgcaguccggccgcaucgucguggacuacaugaugcagaagcccgggaagaccggcaccaucguguaccagcgcgggguccugcugccccagaagguguggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucacgaagaaccugaacucccugagcgagcucgaggugaagaaccugcagcggcuguccggggccauggacgagcuccacaacgagauccuggagcuggacgagaagguggacgaccuccgcgccgacaccaucagcucccagaucgagcuggcgguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugcuggccaucuucaucgucuacauggugucccgggacaacgugagcugcuccaucugccucuga

SEQ ID NO: 89377 - RNA, 1755 nt, Artificial Sequence; identical to SEQ ID NO: 87575
  derived and/or modified sequence opt1 from hemagglutinin__InfluenzaB__AIL95010

SEQ ID NO: 89378 - RNA, 1755 nt, Artificial Sequence; identical to SEQ ID NO: 87828
  derived and/or modified sequence opt1 from hemagglutinin__InfluenzaB__AIL95021

SEQ ID NO: 89379 - RNA, 1758 nt, Artificial Sequence; identical to SEQ ID NO: 87656
  derived and/or modified sequence opt1 from hemagglutinin__InfluenzaB__AIL95032

SEQ ID NO: 89380 - RNA, 1755 nt, Artificial Sequence; identical to SEQ ID NO: 87828
  derived and/or modified sequence opt1 from hemagglutinin__InfluenzaB__AIL95043

SEQ ID NO: 89381 - RNA, 1758 nt, Artificial Sequence; identical to SEQ ID NO: 87702
  derived and/or modified sequence opt1 from hemagglutinin__InfluenzaB__AIL95054

SEQ ID NO: 89382 - RNA, 1758 nt, Artificial Sequence; identical to SEQ ID NO: 87656
  derived and/or modified sequence opt1 from hemagglutinin__InfluenzaB__AIL95065

SEQ ID NO: 89383 - RNA, 1758 nt, Artificial Sequence; identical to SEQ ID NO: 87653
  derived and/or modified sequence opt1 from hemagglutinin__InfluenzaB__AIL95076

SEQ ID NO: 89384 - RNA, 1758 nt, Artificial Sequence; identical to SEQ ID NO: 87656
  derived and/or modified sequence opt1 from hemagglutinin__InfluenzaB__AIL95087

SEQ ID NO: 89385 - RNA, 1755 nt, Artificial Sequence; identical to SEQ ID NO: 87828
  derived and/or modified sequence opt1 from hemagglutinin__InfluenzaB__AIL95098

SEQ ID NO: 89386 - RNA, 1758 nt, Artificial Sequence; identical to SEQ ID NO: 89167
  derived and/or modified sequence opt1 from hemagglutinin__InfluenzaB__AIL95109

SEQ ID NO: 89387 - RNA, 1758 nt, Artificial Sequence
  derived and/or modified sequence opt1 from hemagglutinin__InfluenzaB__AIL95120
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggacaagaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 89388 - RNA, 1755 nt, Artificial Sequence; identical to SEQ ID NO: 89297
  derived and/or modified sequence opt1 from hemagglutinin__InfluenzaB__AKA54644

SEQ ID NO: 89389 - RNA, 1755 nt, Artificial Sequence
  derived and/or modified sequence opt1 from hemagglutinin__InfluenzaB__AKA54645
augaaggccaucaccgugcugcucauggucgugaccagcaacgccgaccgcaucugcacgggcaucaccuccagcaacagcccccacguggucaagaccgcgacccagggggaggugaacgugacgggcgucaucccgcugaccaccacccccacgaaguccuacuucgccaaccugaaggggacccggacccgcggcaagcucugccccgacugccugaacugcaccgaccuggacguggcccucgggcggcccaugugcgugggcacgaccccguccgccaaggccagcauccugcacgagguccgccccgugaccuccggcugcuuccccaucaugcacgaccggaccaagauccgccagcugcccaaccuccugcggggguacgagaagauccgccugagcacgcagaacgugaucgacgcggagaaggccccgggcgggcccuaccggcucggcaccuccgggagcugccccaacgccaccuccaagaucggcuucuucgccaccauggcgugggccguccccaaggacaacuacaagaacgccacgaacccgcugaccguggaggugcccuacaucugcaccgagggcgaggaccagaucaccgucuggggguuccacagcgacaacaagacgcagaugaagucccuguacggcgacagcaacccccagaaguucaccuccagcgccgacggggugaccacccacuacgugucccagaucggcgacuuccccgaccagacggaggacggcgggcucccgcagagcggccgcaucgucguggacuacaugaugcagaagcccgggaagaccggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucacgaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccacguucgacucccugaacaucaccgccgccagccucaacgacgacgggcuggacaaccacaccauccugcuguacuacuccaccgccgcgagcucccucgccgugacgcugaugcuggccaucuucaucgucuacauggugagccgggacaacguguccugcagcaucugccucuga

SEQ ID NO: 89390 - RNA, 1755 nt, Artificial Sequence; identical to SEQ ID NO: 89297
  derived and/or modified sequence opt1 from hemagglutinin__InfluenzaB__AKA54646

SEQ ID NO: 89391 - RNA, 1755 nt, Artificial Sequence; identical to SEQ ID NO: 89297
  derived and/or modified sequence opt1 from hemagglutinin__InfluenzaB__AKA54647

SEQ ID NO: 89392 - RNA, 1758 nt, Artificial Sequence; identical to SEQ ID NO: 87895
  derived and/or modified sequence opt1 from hemagglutinin__InfluenzaB__AKA54648

SEQ ID NO: 89393 - RNA, 1755 nt, Artificial Sequence
  derived and/or modified sequence opt1 from hemagglutinin__InfluenzaB__AKA54649
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacaccaccuccaagaucggcuucuucgccaccauggccugggcgguccccaaggacaacuacaagaacgccacgaacccgcugaccguggaggugcccuacaucugcaccgagggcgaggaccagaucaccgucuggggguuccacagcgacaacaagacgcagaugaagucccuguacggcgacagcaacccccagaaguucaccuccagcgccaacggggugaccacccacuacgugucccagaucggcgacuuccccgaccagacggaggacggcgggcucccgcagagcggccgcaucgucguggacuacaugaugcagaagcccgggaagaccggcaccaucguguaccagcgcgggguccugcugccccagaagguguggugcgccuccggccggagcaaggugaucaagggcagccucccccugaucggggaggccgacugccugcacgaggaguacggcgggcucaacaaguccaagccguacuacaccggcaagcacgcgaaggccaucgggaacugccccaucugggucaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccagccacggggcccacggcguggccgucgccgcggaccucaaguccacccaggaggccaucaacaagaucacgaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggccguccugcucuccaacgagggcaucaucaacagcgaggacgagcaccuccuggcgcuggagcggaagcugaagaagaugcugggccccuccgccguggacaucgggaacggcugcuucgagaccaagcacaagugcaaccagaccugccucgaccgcaucgccgccgggaccuucaacgcgggcgaguucagccugcccacguucgacucccugaacaucaccgccgccagccucaacgacgacgggcuggacaaccacaccauccugcuguacuacuccaccgccgccagcucccucgcggugacgcugaugcuggccaucuucaucgucuacauggugagccgggacaacguguccugcagcaucugccucuga

SEQ ID NO: 89394 - RNA, 1755 nt, Artificial Sequence; identical to SEQ ID NO: 89297
  derived and/or modified sequence opt1 from hemagglutinin__InfluenzaB__AKU40581

SEQ ID NO: 89395 - RNA, 1755 nt, Artificial Sequence; identical to SEQ ID NO: 89297
  derived and/or modified sequence opt1 from hemagglutinin__InfluenzaB__AKU40592

SEQ ID NO: 89396 - RNA, 1755 nt, Artificial Sequence; identical to SEQ ID NO: 89137
  derived and/or modified sequence opt1 from hemagglutinin__InfluenzaB__AKU40603

SEQ ID NO: 89397 - RNA, 1755 nt, Artificial Sequence; identical to SEQ ID NO: 89297
  derived and/or modified sequence opt1 from hemagglutinin__InfluenzaB__AKU40614

SEQ ID NO: 89398 - RNA, 1755 nt, Artificial Sequence; identical to SEQ ID NO: 89137
  derived and/or modified sequence opt1 from hemagglutinin__InfluenzaB__AKU40625

SEQ ID NO: 89399 - RNA, 1755 nt, Artificial Sequence
  derived and/or modified sequence opt1 from hemagglutinin__InfluenzaB__AKU40636
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccgccaaguccuacuucgccaaccugaaggggacccggacgcgcggcaagcucugccccgacugccugaacugcaccgaccuggacguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguacgagaacauccgccugagcaccaagaacgugaucgacgccgagaaggccccgggcgggcccuaccggcucggcaccuccgggagcugccccaacgccacguccaagaucggcuucuucgcgaccauggccugggccguccccaaggacaacuacaagaacgccaccaacccgcugaccguggaggugcccuacaucugcaaggagggcgaggaccagaucacggucuggggguuccacagcgacaacaagacccagaugaagaaccuguacggcgacuccaacccccagaaguucaccagcuccgccaacggggugaccacgcacuacgugagccagaucggcgacuuccccgaccagaccgaggacggcgggcucccgcaguccggccgcaucgucguggacuacaugaugcagaagcccgggaagaccggcaccaucguguaccagcgcgggguccugcugccccagaagguguggugcgcgagcggccgguccaaggugaucaagggcagccucccccugaucggggaggccgacugccugcacgaggaguacggcgggcucaacaagagcaagccguacuacacgggcaagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaacaagaucaccaagaaccugaacucccugagcgagcucgaggugaagaaccugcagcggcuguccggggccauggacgagcuccacaacgagauccuggagcuggacgagaagguggacgaccuccgcgcggacaccaucagcucccagaucgagcuggccguccugcucagcaacgagggcaucaucaacuccgaggacgagcaccuccuggcccuggagcggaagcugaagaagaugcugggccccagcgccguggacaucgggaacggcugcuucgagaccaagcacaagugcaaccagacgugccucgaccgcaucgcggccgggaccuucaacgccggcgaguucucccugcccaccuucgacagccugaacaucaccgccgccucccucaacgacgacgggcuggacaaccacaccauccugcuguacuacagcacggcggccuccagccucgccgugacccugaugcuggccaucuucaucgucuacauggugucccgggacaacgugagcugcuccaucugccucuga

SEQ ID NO: 89400 - RNA, 1755 nt, Artificial Sequence
  derived and/or modified sequence opt1 from hemagglutinin__InfluenzaB__AKU40647
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggagauccccuacaucugcaccgagggcgaggaccagaucaccguguggggguuccacagcgacaacaagacccagaugaagucccuguacggcgacagcaacccccagaaguucacguccagcgccaacggggucaccacccacuacgugucccagaucggcgacuuccccgaccagaccgaggacggcgggcugccgcagagcggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccgucgacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucguguacauggucagccgggacaacguguccugcagcaucugccuguga

SEQ ID NO: 89401 - RNA, 1755 nt, Artificial Sequence; identical to SEQ ID NO: 89297
  derived and/or modified sequence opt1 from hemagglutinin__InfluenzaB__AKU40658

SEQ ID NO: 89402 - RNA, 1755 nt, Artificial Sequence; identical to SEQ ID NO: 89297
  derived and/or modified sequence opt1 from hemagglutinin__InfluenzaB__AKU40669

SEQ ID NO: 89403 - RNA, 1755 nt, Artificial Sequence; identical to SEQ ID NO: 89297
  derived and/or modified sequence opt1 from hemagglutinin__InfluenzaB__AKU40680

SEQ ID NO: 89404 - RNA, 1755 nt, Artificial Sequence
  derived and/or modified sequence opt1 from hemagglutinin__InfluenzaB__AKU40691
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgaguuccacaacgagauccuggagcucgacgagaagguggacgaccugcgcgccgacacgaucuccagccagaucgagcuggcgguccuccuguccaacgagggcaucaucaacagcgaggacgagcaccuccuggcccuggagcggaagcugaagaagaugcucggccccuccgccguggacaucgggaacggcugcuucgagaccaagcacaagugcaaccagaccugccuggaccgcaucgccgcggggaccuucaacgccggcgaguucagccugcccaccuucgacucccucaacaucacggccgccagccugaacgacgacgggcuggacaaccacaccauccuccuguacuacuccaccgccgcgagcucccuggccgugacccugaugcucgccaucuucaucgucuacauggugagccgggacaacguguccugcagcaucugccuguga

SEQ ID NO: 89405 - RNA, 1755 nt, Artificial Sequence; identical to SEQ ID NO: 89297
  derived and/or modified sequence opt1 from hemagglutinin__InfluenzaB__AKU40702

SEQ ID NO: 89406 - RNA, 1755 nt, Artificial Sequence; identical to SEQ ID NO: 89297
  derived and/or modified sequence opt1 from hemagglutinin__InfluenzaB__AKU40713

SEQ ID NO: 89407 - RNA, 1755 nt, Artificial Sequence; identical to SEQ ID NO: 89137
  derived and/or modified sequence opt1 from hemagglutinin__InfluenzaB__AKU40724

SEQ ID NO: 89408 - RNA, 1755 nt, Artificial Sequence; identical to SEQ ID NO: 89400
  derived and/or modified sequence opt1 from hemagglutinin__InfluenzaB__AKU40735

SEQ ID NO: 89409 - RNA, 1755 nt, Artificial Sequence; identical to SEQ ID NO: 89297
  derived and/or modified sequence opt1 from hemagglutinin__InfluenzaB__AKU40746

SEQ ID NO: 89410 - RNA, 1755 nt, Artificial Sequence; identical to SEQ ID NO: 89297
  derived and/or modified sequence opt1 from hemagglutinin__InfluenzaB__AKU40757

SEQ ID NO: 89411 - RNA, 1755 nt, Artificial Sequence; identical to SEQ ID NO: 89297
  derived and/or modified sequence opt1 from hemagglutinin__InfluenzaB__AKU40768

SEQ ID NO: 89412 - RNA, 1755 nt, Artificial Sequence; identical to SEQ ID NO: 89297
  derived and/or modified sequence opt1 from hemagglutinin__InfluenzaB__AKU40779

SEQ ID NO: 89413 - RNA, 1755 nt, Artificial Sequence; identical to SEQ ID NO: 89137
  derived and/or modified sequence opt1 from hemagglutinin__InfluenzaB__AKU40790

SEQ ID NO: 89414 - RNA, 1755 nt, Artificial Sequence; identical to SEQ ID NO: 89297
  derived and/or modified sequence opt1 from hemagglutinin__InfluenzaB__AKU40801

SEQ ID NO: 89415 - RNA, 1755 nt, Artificial Sequence
  derived and/or modified sequence opt1 from hemagglutinin__InfluenzaB__AKU40812
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacucccacaccauccugcuguacuacagcaccgccgcguccagccuggccgugacccucaugcuggccaucuucaucgucuacauggugucccgggacaacgugagcugcagcaucugccuguga

SEQ ID NO: 89416 - RNA, 1755 nt, Artificial Sequence; identical to SEQ ID NO: 89297
  derived and/or modified sequence opt1 from hemagglutinin__InfluenzaB__AKU40823

SEQ ID NO: 89417 - RNA, 1755 nt, Artificial Sequence; identical to SEQ ID NO: 89297
  derived and/or modified sequence opt1 from hemagglutinin__InfluenzaB__AKU40834

SEQ ID NO: 89418 - RNA, 1755 nt, Artificial Sequence; identical to SEQ ID NO: 89297
  derived and/or modified sequence opt1 from hemagglutinin__InfluenzaB__AKU40845

SEQ ID NO: 89419 - RNA, 1755 nt, Artificial Sequence; identical to SEQ ID NO: 89297
  derived and/or modified sequence opt1 from hemagglutinin__InfluenzaB__AKU40856

SEQ ID NO: 89420 - RNA, 1755 nt, Artificial Sequence; identical to SEQ ID NO: 89297
  derived and/or modified sequence opt1 from hemagglutinin__InfluenzaB__AKU40867

SEQ ID NO: 89421 - RNA, 1755 nt, Artificial Sequence; identical to SEQ ID NO: 89297
  derived and/or modified sequence opt1 from hemagglutinin__InfluenzaB__AKU40878

SEQ ID NO: 89422 - RNA, 1758 nt, Artificial Sequence
  derived and/or modified sequence opt1 from hemagglutinin__InfluenzaB__AKU40889
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaccgaggugcccuacaucugcaccgagggggaggaccagaucaccgucuggggcuuccacuccgacaacgagacgcagauggccaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguucgacgcgggcgaguucucccuccccaccuucgacagccugaacaucaccgccgccucccugaacgacgacggccucgacaaccacaccauccugcuguacuacagcacggccgccuccagccuggcggugacccucaugaucgccaucuucguggucuacauggugucccgcgacaacgugagcugcuccaucugccuguga

SEQ ID NO: 89423 - RNA, 1755 nt, Artificial Sequence; identical to SEQ ID NO: 89297
  derived and/or modified sequence opt1 from hemagglutinin__InfluenzaB__AKU40900

SEQ ID NO: 89424 - RNA, 1755 nt, Artificial Sequence; identical to SEQ ID NO: 89137
  derived and/or modified sequence opt1 from hemagglutinin__InfluenzaB__AKU40911

SEQ ID NO: 89425 - RNA, 1755 nt, Artificial Sequence
  derived and/or modified sequence opt1 from hemagglutinin__InfluenzaB__AKU40922
augaaggccaucaucgugcugcucauggucgugaccagcaacgccgaccgcaucugcaccggcaucacguccagcaacagcccccacguggucaagaccgugacccagggggaggugaacgucaccggcgugaucccgcugacgaccacccccaccaaguccuacuucgcgaaccugaaggggacgcggacccgcggcaagcucugccccgacugccugaacugcaccgaccuggacguggcccucgggcggcccaugugcgucggcaccacgccguccgccaaggccagcauccugcacgaggugcgccccgugaccuccggcugcuuccccaucaugcacgaccggaccaagauccgccagcugcccaaccuccugcggggguacgagaagauccgccugagcacccagaacgucaucgacgccgagaaggcgccgggcgggcccuaccggcucggcacguccgggagcugccccaacgccaccuccaagaucggcuucuucgccaccauggccugggcggugcccaaggacaacuacaagaacgccaccaacccgcagacgguggagguccccuacaucugcaccgagggcgaggaccagaucaccguguggggguuccacagcgacaacaagacccagaugaagucccuguacggcgacagcaacccccagaaguucacguccagcgccaacggggugaccacccacuacgucucccagaucggcgacuuccccgaccagaccgaggacggcgggcugccgcagagcggccgcaucgugguggacuacaugaugcagaagcccgggaagacgggcaccaucgucuaccagcgcggggugcuccugccccagaagguguggugcgccuccggccggagcaaggucaucaagggcagccugccccucaucggggaggccgacugccugcacgaggaguacggcgggcugaacaaguccaagccguacuacaccggcaagcacgcgaaggccaucgggaacugccccaucugggugaagacgccccucaagcuggccaacggcaccaaguaccggcccccggccaagcugcucaaggagcgcggcuucuucggggccaucgcgggcuuccuggagggcgggugggaggggaugaucgccggcuggcacggcuacaccagccacggggcccacggcgucgccguggccgcggaccugaaguccacccaggaggccaucaacaagaucaccaagaaccucaacagccuguccgagcuggaggugaagaaccuccagcggcugagcggggccauggacgagcugcacaacgagauccucgagcuggacgagaaggucgacgaccugcgcgccgacacgaucuccagccagaucgagcucgccgugcugcuguccaacgagggcaucaucaacagcgaggacgagcaccuccuggcgcuggagcggaagcucaagaagaugcugggccccuccgccguggacaucgggaacggcugcuucgagaccaagcacaagugcaaccagaccugccuggaccgcaucgccgccgggaccuucaacgcgggcgaguucagccuccccaccuucgacucccugaacaucacggccgccagccugaacgacgacgggcucgacaaccacaccauccugcuguacuacuccaccgccgccagcucccuggcggucacccucaugcuggccaucuucaucguguacauggugagccgggacaacgucuccugcagcaucugccuguga

SEQ ID NO: 89426 - RNA, 1755 nt, Artificial Sequence; identical to SEQ ID NO: 89400
  derived and/or modified sequence opt1 from hemagglutinin__InfluenzaB__AKU40933

SEQ ID NO: 89427 - RNA, 1755 nt, Artificial Sequence; identical to SEQ ID NO: 89297
  derived and/or modified sequence opt1 from hemagglutinin__InfluenzaB__AKU40944

SEQ ID NO: 89428 - RNA, 1755 nt, Artificial Sequence; identical to SEQ ID NO: 89297
  derived and/or modified sequence opt1 from hemagglutinin__InfluenzaB__AKU40955

SEQ ID NO: 89429 - RNA, 1755 nt, Artificial Sequence; identical to SEQ ID NO: 89297
  derived and/or modified sequence opt1 from hemagglutinin__InfluenzaB__AKU40966

SEQ ID NO: 89430 - RNA, 1755 nt, Artificial Sequence; identical to SEQ ID NO: 89297
  derived and/or modified sequence opt1 from hemagglutinin__InfluenzaB__AKU40977

SEQ ID NO: 89431 - RNA, 1755 nt, Artificial Sequence; identical to SEQ ID NO: 89297
  derived and/or modified sequence opt1 from hemagglutinin__InfluenzaB__AKU40987

SEQ ID NO: 89432 - RNA, 1755 nt, Artificial Sequence; identical to SEQ ID NO: 89297
  derived and/or modified sequence opt1 from hemagglutinin__InfluenzaB__AKU40998

SEQ ID NO: 89433 - RNA, 1755 nt, Artificial Sequence; identical to SEQ ID NO: 89297
  derived and/or modified sequence opt1 from hemagglutinin__InfluenzaB__AKU41009

SEQ ID NO: 89434 - RNA, 1755 nt, Artificial Sequence; identical to SEQ ID NO: 89297
  derived and/or modified sequence opt1 from hemagglutinin__InfluenzaB__AKU41020

SEQ ID NO: 89435 - RNA, 1755 nt, Artificial Sequence; identical to SEQ ID NO: 89297
  derived and/or modified sequence opt1 from hemagglutinin__InfluenzaB__ALA08485

SEQ ID NO: 89436 - RNA, 1755 nt, Artificial Sequence; identical to SEQ ID NO: 89297
  derived and/or modified sequence opt1 from hemagglutinin__InfluenzaB__ALA08486

SEQ ID NO: 89437 - RNA, 1755 nt, Artificial Sequence; identical to SEQ ID NO: 89297
  derived and/or modified sequence opt1 from hemagglutinin__InfluenzaB__ALA08487

SEQ ID NO: 89438 - RNA, 1755 nt, Artificial Sequence; identical to SEQ ID NO: 89297
  derived and/or modified sequence opt1 from hemagglutinin__InfluenzaB__ALA08564

SEQ ID NO: 89439 - RNA, 1755 nt, Artificial Sequence; identical to SEQ ID NO: 89297
  derived and/or modified sequence opt1 from hemagglutinin__InfluenzaB__ALA08565

SEQ ID NO: 89440 - RNA, 1755 nt, Artificial Sequence; identical to SEQ ID NO: 89297
  derived and/or modified sequence opt1 from hemagglutinin__InfluenzaB__ALA08566

SEQ ID NO: 89441 - RNA, 1755 nt, Artificial Sequence; identical to SEQ ID NO: 89297
  derived and/or modified sequence opt1 from hemagglutinin__InfluenzaB__ALA08567

SEQ ID NO: 89442 - RNA, 1755 nt, Artificial Sequence; identical to SEQ ID NO: 89297
  derived and/or modified sequence opt1 from hemagglutinin__InfluenzaB__ALA08568

SEQ ID NO: 89443 - RNA, 1755 nt, Artificial Sequence; identical to SEQ ID NO: 89297
  derived and/or modified sequence opt1 from hemagglutinin__InfluenzaB__ALA08569

SEQ ID NO: 89444 - RNA, 1758 nt, Artificial Sequence
  derived and/or modified sequence opt1 from hemagglutinin__InfluenzaB__ALA08689
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugagcacccacaacgugaucaacgccgagaacgcgcccggcgggcccuacaagaucggcaccuccgggagcugccccaacgucacgaacggcaacggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaacgagacccagauggccaagcucuacggggacagcaacccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccagcgggcgguccaaggugaucaagggcagccugccccugaucggggaggccgacugccuccacgagaaguacggcgggcugaacaagagcaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucagcucccagaucgagcuggccgugcuccugagcaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuucgacgcgggcgaguucucccugcccacguucgacagccucaacaucaccgccgccucccugaacgacgacggccuggacaaccacaccauccuccuguacuacagcaccgccgccuccagccuggcggugacgcugaugaucgccaucuucguggucuacauggugucccgcgacaacgugagcugcuccaucugccucuga

SEQ ID NO: 89445 - RNA, 1758 nt, Artificial Sequence
  derived and/or modified sequence opt1 from hemagglutinin__InfluenzaB__ALA08690
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacaucacgaacggcaacggcuucuucgccaccauggccugggccguccagaagaacgacaagaacaagaccgcgaccaacccccucacgaucgaggugccguacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccccagagcggccggaucguggucgacuacauggugcagaaguccgggaagacgggcaccaucaccuaccagcgcggcauccuccugccgcagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacgaccacaccauccugcuguacuacagcaccgccgccuccagccuggcggucacgcucaugaucgccaucuucgugguguacauggucucccgcgacaacgugagcugcuccaucugccuguga

SEQ ID NO: 89446 - RNA, 1755 nt, Artificial Sequence; identical to SEQ ID NO: 89297
  derived and/or modified sequence opt1 from hemagglutinin__InfluenzaB__ALE31766

SEQ ID NO: 89447 - RNA, 1758 nt, Artificial Sequence
  derived and/or modified sequence opt1 from hemagglutinin__InfluenzaB__ALE31768
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89448 - RNA, 1758 nt, Artificial Sequence
  derived and/or modified sequence opt1 from hemagglutinin__InfluenzaB__ALE31770
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacaucagccuguccacccacaacgugaucaacgccgaggacgcgccgggcgggcccuacaagaucggcaccagcggguccugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccgcaguccggccgcaucgucguggacuacauggugcagaaguccgggaagacgggcaccaucaccuaccagcggggcauccuccugccccagaaggucuggugcgccuccgggcgcagcaaggugaucaagggcagccugccccucaucggggaggccgacugccugcacgagaaguacggcgggcugaacaaguccaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcggcugagcggcgccauggacgagcugcacaacgagauccucgagcuggacgagaagguggacgaccugcgcgccgacaccaucuccagccagaucgagcucgccgugcugcuguccaacgaggggaucaucaacagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgggacaacguguccugcagcaucugccuguga

SEQ ID NO: 89449 - RNA, 1755 nt, Artificial Sequence; identical to SEQ ID NO: 89297
  derived and/or modified sequence opt1 from hemagglutinin__InfluenzaB__ALE31772

SEQ ID NO: 89450 - RNA, 1755 nt, Artificial Sequence; identical to SEQ ID NO: 89297
  derived and/or modified sequence opt1 from hemagglutinin__InfluenzaB__ALE31773

SEQ ID NO: 89451 - RNA, 1755 nt, Artificial Sequence
  derived and/or modified sequence opt1 from hemagglutinin__InfluenzaB__ALE31884
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgggacaacguguccugcagcgucugccuguga

SEQ ID NO: 89452 - RNA, 1755 nt, Artificial Sequence
  derived and/or modified sequence opt1 from hemagglutinin__InfluenzaB__ALE31885
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucgucguguacauggugagccgggacaacgucuccugcagcaucugccuguga

SEQ ID NO: 89453 - RNA, 1755 nt, Artificial Sequence; identical to SEQ ID NO: 89297
  derived and/or modified sequence opt1 from hemagglutinin__InfluenzaB__ALE31886

SEQ ID NO: 89454 - RNA, 1755 nt, Artificial Sequence
  derived and/or modified sequence opt1 from hemagglutinin__InfluenzaB__ALE31887
augaaggccaucaucgugcugcucauggucgugaccagcaacgccgaccgcaucugcaccggcaucacguccagcaacagcccccacguggucaagaccgcgacccagggggagaucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcagacggucgaggugcccuacaucugcaccgagggcgaggaccagaucaccguguggggguuccacagcgacaacaagacccagaugaagucccuguacggcgacagcaacccccagaaguucacguccagcgccaacggggucaccacccacuacgugucccagaucggcgacuuccccgaccagaccgaggacggcgggcugccgcagagcggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccgucgacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucguguacauggucagccgggacaacguguccugcagcaucugccuguga

SEQ ID NO: 89455 - RNA, 1755 nt, Artificial Sequence; identical to SEQ ID NO: 89297
  derived and/or modified sequence opt1 from hemagglutinin__InfluenzaB__ALE31982

SEQ ID NO: 89456 - RNA, 1755 nt, Artificial Sequence
  derived and/or modified sequence opt1 from hemagglutinin__InfluenzaB__ALE31983
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggcccuguucaucgucuacauggugagccgggacaacguguccugcagcaucugccucuga

SEQ ID NO: 89457 - RNA, 1755 nt, Artificial Sequence
  derived and/or modified sequence opt1 from hemagglutinin__InfluenzaB__ALE31984
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgaggaggaggaccagaucaccgucuggggcuuccacagcgacaacaagacccagaugaagucccuguacggggacagcaacccccagaaguucacguccagcgccaacggcgugaccacccacuacgugucccagaucggggacuuccccgaccagaccgaggacggcggccugccgcagagcgggcgcaucgucguggacuacauggugcagaagcccggcaagacggggaccaucgucuaccagcggggcgugcuccugccccagaagguguggugcgccuccgggcgcagcaaggucaucaagggcagccugccccucaucggcgaggcggacugccugcacgaggaguacgggggccugaacaaguccaagccguacuacaccgggaagcacgccaaggccaucggcaacugccccaucugggugaagacgccccucaagcuggccaacgggaccaaguaccggcccccggccaagcugcucaaggagcgcggcuucuucggcgcgaucgccggguuccuggagggcgggugggagggcaugaucgccggguggcacggcuacaccagccacggcgcccacggggucgccguggcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacacgaucuccagccagaucgagcucgcggugcugcuguccaacgaggggaucaucaacagcgaggacgagcaccuccuggcccuggagcggaagcucaagaagaugcugggccccuccgccguggacaucggcaacgggugcuucgagaccaagcacaagugcaaccagaccugccuggaccgcaucgccgcgggcaccuucaacgccggggaguucagccuccccaccuucgacucccugaacaucacggccgccagccugaacgacgacggccucgacaaccacaccauccugcuguacuacuccaccgccgcgagcucccuggccgucacccucaugcuggccaucuucaucguguacauggugagccgggacaacgucuccugcagcaucugccuguga

SEQ ID NO: 89458 - RNA, 1755 nt, Artificial Sequence; identical to SEQ ID NO: 89297
  derived and/or modified sequence opt1 from hemagglutinin__InfluenzaB__ALE31985

SEQ ID NO: 89459 - RNA, 1758 nt, Artificial Sequence
  derived and/or modified sequence opt1 from hemagglutinin__InfluenzaB__ALE31986
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucgugaucgacuacaugguccagaaguccgggaagacgggcaccaucaccuaccagcgcggcauccuccugccccagaagguguggugcgccagcgggcgguccaaggugaucaagggcagccugccccucaucggggaggccgacugccugcacgagaaguacggcgggcugaacaagagcaagcccuacuacaccggcgagcacgcgaaggccgucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggucacgcucaugaucgccaucuucgugguguacauggucucccgcgacaacgugagcugcuccaucugccuguga

SEQ ID NO: 89460 - RNA, 1755 nt, Artificial Sequence
  derived and/or modified sequence opt1 from hemagglutinin__InfluenzaB__ALE31988
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacauggugcagaagcccgggaagacgggcaccaucgucuaccagcgcggggugcuccugccccagaagguguggugcgccuccggccggagcaaggucaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaaggucgacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgucacccucaugcuggccaucuucaucguguacauggugagccgggacaacgucuccugcagcaucugccuguga

SEQ ID NO: 89461 - RNA, 1758 nt, Artificial Sequence; identical to SEQ ID NO: 89459
  derived and/or modified sequence opt1 from hemagglutinin__InfluenzaB__ALE31989

SEQ ID NO: 89462 - RNA, 1758 nt, Artificial Sequence; identical to SEQ ID NO: 89459
  derived and/or modified sequence opt1 from hemagglutinin__InfluenzaB__ALE31990

SEQ ID NO: 89463 - RNA, 1755 nt, Artificial Sequence; identical to SEQ ID NO: 89297
  derived and/or modified sequence opt1 from hemagglutinin__InfluenzaB__ALE31991

SEQ ID NO: 89464 - RNA, 1758 nt, Artificial Sequence
  derived and/or modified sequence opt1 from hemagglutinin__InfluenzaB__ALE31992
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagcgggaggaccagaucaccgucuggggguuccacuccgacaacgagacccagauggccaagcuguacggcgacagcaagccccagaaguucacguccagcgccaacggggugaccacccacuacgugucccagaucggcggcuuccccaaccagaccgaggacgggggccugccgcagagcgggcgcaucgucguggacuacauggugcagaaguccggcaagacggggaccaucaccuaccagcggggcauccuccugccccagaaggucuggugcgccagcggccgcuccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccggccgcccgccaagcugcucaaggagcgcggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgagggcaucaucaacuccgaggacgagcaccuccuggcgcuggagcggaagcucaagaagaugcuggggcccagcgccgucgagaucggcaacgggugcuucgagaccaagcacaagugcaaccagaccugccuggaccgcaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 89465 - RNA, 1758 nt, Artificial Sequence; identical to SEQ ID NO: 88873
  derived and/or modified sequence opt1 from hemagglutinin__InfluenzaB__ALE31993

SEQ ID NO: 89466 - RNA, 1758 nt, Artificial Sequence
  derived and/or modified sequence opt1 from hemagglutinin__InfluenzaB__ALE31994
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugcgcacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgaggggaucaucaacuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 89467 - RNA, 1755 nt, Artificial Sequence; identical to SEQ ID NO: 89456
  derived and/or modified sequence opt1 from hemagglutinin__InfluenzaB__ALN39719

SEQ ID NO: 89468 - RNA, 1755 nt, Artificial Sequence; identical to SEQ ID NO: 89297
  derived and/or modified sequence opt1 from hemagglutinin__InfluenzaB__ALN39720

SEQ ID NO: 89469 - RNA, 1755 nt, Artificial Sequence; identical to SEQ ID NO: 89297
  derived and/or modified sequence opt1 from hemagglutinin__InfluenzaB__ALN39721

SEQ ID NO: 89470 - RNA, 1755 nt, Artificial Sequence; identical to SEQ ID NO: 89297
  derived and/or modified sequence opt1 from hemagglutinin__InfluenzaB__ALN39723

SEQ ID NO: 89471 - RNA, 1755 nt, Artificial Sequence; identical to SEQ ID NO: 89297
  derived and/or modified sequence opt1 from hemagglutinin__InfluenzaB__ALN39724

SEQ ID NO: 89472 - RNA, 1755 nt, Artificial Sequence; identical to SEQ ID NO: 89460
  derived and/or modified sequence opt1 from hemagglutinin__InfluenzaB__ALN39725

SEQ ID NO: 89473 - RNA, 1755 nt, Artificial Sequence
  derived and/or modified sequence opt1 from hemagglutinin__InfluenzaB__ALN39726
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccgacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgggacaacguguccugcagcaucugccuguga

SEQ ID NO: 89474 - RNA, 1755 nt, Artificial Sequence; identical to SEQ ID NO: 89460
  derived and/or modified sequence opt1 from hemagglutinin__InfluenzaB__ALN39727

SEQ ID NO: 89475 - RNA, 1755 nt, Artificial Sequence; identical to SEQ ID NO: 89297
  derived and/or modified sequence opt1 from hemagglutinin__InfluenzaB__ALN39728

SEQ ID NO: 89476 - RNA, 1755 nt, Artificial Sequence; identical to SEQ ID NO: 89297
  derived and/or modified sequence opt1 from hemagglutinin__InfluenzaB__ALN39729

SEQ ID NO: 89477 - RNA, 1758 nt, Artificial Sequence
  derived and/or modified sequence opt1 from hemagglutinin__InfluenzaB__ALN39730
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucuuccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccuguga

SEQ ID NO: 89478 - RNA, 1755 nt, Artificial Sequence; identical to SEQ ID NO: 89297
  derived and/or modified sequence opt1 from hemagglutinin__InfluenzaB__ALN39732

SEQ ID NO: 89479 - RNA, 1755 nt, Artificial Sequence
  derived and/or modified sequence opt1 from hemagglutinin__InfluenzaB__ALN39733
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcaccgcugcaaccagaccugccuggaccggaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgcgacaacguguccugcagcaucugccuguga

SEQ ID NO: 89480 - RNA, 1755 nt, Artificial Sequence
  derived and/or modified sequence opt1 from hemagglutinin__InfluenzaB__ALN39751
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugguggccggcuggcacggcuacaccagccacggggcccacggcgucgccguggcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaaggucgacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgucacccucaugcuggcccuguucaucguguacauggugagccgggacaacgucuccugcagcaucugccucuga

SEQ ID NO: 89481 - RNA, 1755 nt, Artificial Sequence; identical to SEQ ID NO: 89456
  derived and/or modified sequence opt1 from hemagglutinin__InfluenzaB__ALN39752

SEQ ID NO: 89482 - RNA, 1755 nt, Artificial Sequence; identical to SEQ ID NO: 89297
  derived and/or modified sequence opt1 from hemagglutinin__InfluenzaB__ALN39753

SEQ ID NO: 89483 - RNA, 1758 nt, Artificial Sequence
  derived and/or modified sequence opt1 from hemagglutinin__InfluenzaB__ALN39754
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89484 - RNA, 1758 nt, Artificial Sequence
  derived and/or modified sequence opt1 from hemagglutinin__InfluenzaB__ALN39755
augaaggccaucaucgugcugcuccuggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccucaaggggacggagacccggggcaagcugugccccaagugccugaacugcaccgaccucgacguggcccuggggcgccccaagugcaccggcaagaucccguccgcccgggugagcauccugcacgagguccgccccgugacguccggcugcuuccccaucaugcacgaccggaccaagauccgccagcuccccaaccugcugcggggguacgagcacgugcgccucagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcugacgaucgaggugcccuacaucugcaccgagggggaggaccagaucaccgucuggggcuuccacuccgacaacgagacccagauggccaagcuguacggggacagcaagccccagaaguucacguccagcgccaacggcgugaccacccacuacgugucccagaucggcggguuccccaaccagaccgaggacggcgggcucccgcagagcggccggaucgucguggacuacauggugcagaaguccgggaagacgggcaccaucaccuaccagcgcggcauccugcugccccagaaggucuggugcgccagcgggcgguccaaggugaucaagggcagccucccccugaucggggaggccgacugccugcacgagaaguacggcgggcucaacaagagcaagcccuacuacaccggcgagcacgcgaaggccaucggcaacugcccgaucugggugaagacgccccugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagagcacccaggaggccaucaacaagaucacgaagaaccugaacucccugagcgagcucgaggucaagaaccugcagcgccuguccggcgccauggacgagcuccacaacgagauccuggagcuggacgagaagguggacgaccuccgggccgacaccaucagcucccagaucgagcuggccgugcugcucagcaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugccucgaccggaucgccgccgggaccuucgacgcgggcgaguucucccugcccacguucgacagccugaacaucaccgccgccucccucaacgacgacggccuggacaaccacaccauccugcuguacuacagcaccgccgccuccagccucgcggugacgcugaugaucgccaucuucguggucuacauggugucccgcgacaacgugagcugcuccaucugccuguga

SEQ ID NO: 89485 - RNA, 1755 nt, Artificial Sequence
  derived and/or modified sequence opt1 from hemagglutinin__InfluenzaB__ALN39756
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgugggcgaguucagccuccccaccuucgacucccugaacaucacggccgccagccugaacgacgacgggcucgacaaccacaccauccugcuguacuacuccaccgccgccagcucccuggcggucacccucaugcuggccaucuucaucguguacauggugagccgggacaacgucuccugcagcaucugccuguga

SEQ ID NO: 89486 - RNA, 1758 nt, Artificial Sequence; identical to SEQ ID NO: 89483
  derived and/or modified sequence opt1 from hemagglutinin__InfluenzaB__ALN39757

SEQ ID NO: 89487 - RNA, 1755 nt, Artificial Sequence; identical to SEQ ID NO: 89297
  derived and/or modified sequence opt1 from hemagglutinin__InfluenzaB__ALN39758

SEQ ID NO: 89488 - RNA, 1755 nt, Artificial Sequence
  derived and/or modified sequence opt1 from hemagglutinin__InfluenzaB__ALN39759
augaagaccaucaucgugcugcucauggucgugaccagcaacgccgaccgcaucugcacgggcaucaccuccagcaacagcccccacguggucaagaccgccacccagggggaggugaacgugacgggcgucaucccgcugaccaccacccccacgaaguccuacuucgcgaaccugaaggggacccggacccgcggcaagcucugccccgacugccugaacugcaccgaccuggacguggcccucgggcggcccaugugcgugggcacgaccccguccgccaaggccagcauccugcacgagguccgccccgugaccuccggcugcuuccccaucaugcacgaccggaccaagauccgccagcugcccaaccuccugcggggguacgagaagauccgccugagcacgcagaacgugaucgacgccgagaaggcgccgggcgggcccuaccggcucggcaccuccgggagcugccccaacgccaccuccaagaucggcuucuucgccaccauggccugggcgguccccaaggacaacuacaagaacgccacgaacccgcagaccguggaggugcccuacaucugcaccgagggcgaggaccagaucaccgucuggggguuccacagcgacaacaagacgcagaugaagucccuguacggcgacagcaacccccagaaguucaccuccagcgccaacggggugaccacccacuacgugucccagaucggcgacuuccccgaccagacggaggacggcgggcugccgcagagcggccgcaucgucguggacuacaugaugcagaagcccgggaagaccggcaccaucguguaccagcgcgggguccuccugccccagaagguguggugcgccuccggccggagcaaggugaucaagggcagccugccccucaucggggaggccgacugccugcacgaggaguacggcgggcugaacaaguccaagccguacuacaccggcaagcacgcgaaggccaucgggaacugccccaucugggucaagacgccccucaagcuggccaacggcaccaaguaccggcccccggccaagcugcucaaggagcgcggcuucuucggggccaucgcgggcuuccuggagggcgggugggaggggaugaucgccggcuggcacggcuacaccagccacggggcccacggcguggccgucgccgcggaccugaaguccacccaggaggccaucaacaagaucacgaagaaccucaacagccuguccgagcuggaggugaagaaccuccagcggcugagcggggccauggacgagcugcacaacgagauccucgagcuggacgagaagguggacgaccugcgcgccgacaccaucuccagccagaucgagcucgccguccugcuguccaacgagggcaucaucaacagcgaggacgagcaccuccuggcgcuggagcggaagcucaagaagaugcugggccccuccgccguggacaucgggaacggcugcuucgagaccaagcacaagugcaaccagaccugccuggaccgcaucgccgccgggaccuucaacgcgggcgaguucagccuccccacguucgacucccugaacaucaccgccgccagccugaacgacgacgggcucgacaaccacaccauccugcuguacuacuccaccgccgccagcucccuggcggugacgcucaugcuggccaucuucaucgucuacauggugagccgggacaacguguccugcagcaucugccuguga

SEQ ID NO: 89489 - RNA, 1758 nt, Artificial Sequence; identical to SEQ ID NO: 89447
  derived and/or modified sequence opt1 from hemagglutinin__InfluenzaB__ALN39760

SEQ ID NO: 89490 - RNA, 1755 nt, Artificial Sequence; identical to SEQ ID NO: 89297
  derived and/or modified sequence opt1 from hemagglutinin__InfluenzaB__ALN39761

SEQ ID NO: 89491 - RNA, 1755 nt, Artificial Sequence; identical to SEQ ID NO: 89297
  derived and/or modified sequence opt1 from hemagglutinin__InfluenzaB__ALN39762

SEQ ID NO: 89492 - RNA, 1755 nt, Artificial Sequence; identical to SEQ ID NO: 89297
  derived and/or modified sequence opt1 from hemagglutinin__InfluenzaB__ALN39763

SEQ ID NO: 89493 - RNA, 1758 nt, Artificial Sequence; identical to SEQ ID NO: 89483
  derived and/or modified sequence opt1 from hemagglutinin__InfluenzaB__ALN39764

SEQ ID NO: 89494 - RNA, 1755 nt, Artificial Sequence
  derived and/or modified sequence opt1 from hemagglutinin__InfluenzaB__ALN39765
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaacaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggcccuguucaucgucuacauggugagccgggacaacguguccugcagcaucugccucuga

SEQ ID NO: 89495 - RNA, 1755 nt, Artificial Sequence; identical to SEQ ID NO: 89460
  derived and/or modified sequence opt1 from hemagglutinin__InfluenzaB__ALN39766

SEQ ID NO: 89496 - RNA, 1755 nt, Artificial Sequence; identical to SEQ ID NO: 89297
  derived and/or modified sequence opt1 from hemagglutinin__InfluenzaB__ALN39767

SEQ ID NO: 89497 - RNA, 1755 nt, Artificial Sequence; identical to SEQ ID NO: 89460
  derived and/or modified sequence opt1 from hemagglutinin__InfluenzaB__ALN39768

SEQ ID NO: 89498 - RNA, 1755 nt, Artificial Sequence
  derived and/or modified sequence opt1 from hemagglutinin__InfluenzaB__ALN39769
augaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgggcggaccaagauccgccagcugcccaaccuccugcggggcuacgagaagauccgccugagcacccagaacgugaucgacgcggagaaggcccccgggggccccuaccggcucgggacguccggcagcugccccaacgccaccuccaagaucggcuucuucgccaccauggcgugggccguccccaaggacaacuacaagaacgccaccaacccgcagacgguggaggugcccuacaucugcaccgagggggaggaccagaucaccgucuggggcuuccacagcgacaacaagacccagaugaagucccuguacggggacagcaacccccagaaguucacguccagcgccaacggcgugaccacccacuacgugucccagaucggcgacuuccccgaccagaccgaggacgggggccugccgcagagcgggcgcaucgucguggacuacaugaugcagaagcccggcaagacggggaccaucguguaccagcggggcguccuccugccccagaagguguggugcgccuccggccgcagcaaggugaucaaggggagccugccccucaucggcgaggcggacugccugcacgaggaguacgggggccugaacaaguccaagccguacuacaccgggaagcacgccaaggccaucggcaacugccccaucugggucaagacgccccucaagcuggccaacggcaccaaguaccggcccccggccaagcugcucaaggagcgcggguucuucggcgcgaucgccggguuccuggagggcgggugggagggcaugaucgccggcuggcacggguacaccagccacggcgcccacgggguggccgucgcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagcggaagcucaagaagaugcuggggcccuccgccguggacaucggcaacgggugcuucgagaccaagcacaagugcaaccagaccugccuggaccgcaucgccgcgggcaccuucaacgccggggaguucagccuccccaccuucgacucccugaacaucacggccgccagccugaacgacgacggccucgacaaccacaccauccugcuguacuacuccaccgccgcgagcucccuggccgugacccucaugcuggccaucuucaucgucuacauggugagccgggacaacguguccugcagcaucugccuguga

SEQ ID NO: 89499 - RNA, 1755 nt, Artificial Sequence; identical to SEQ ID NO: 89456
  derived and/or modified sequence opt1 from hemagglutinin__InfluenzaB__ALN39770

SEQ ID NO: 89500 - RNA, 1755 nt, Artificial Sequence; identical to SEQ ID NO: 89456
  derived and/or modified sequence opt1 from hemagglutinin__InfluenzaB__ALN39771

SEQ ID NO: 89501 - RNA, 1755 nt, Artificial Sequence; identical to SEQ ID NO: 89297
  derived and/or modified sequence opt1 from hemagglutinin__InfluenzaB__ALN39773

SEQ ID NO: 89502 - RNA, 1755 nt, Artificial Sequence; identical to SEQ ID NO: 89297
  derived and/or modified sequence opt1 from hemagglutinin__InfluenzaB__ALN39774

SEQ ID NO: 89503 - RNA, 1758 nt, Artificial Sequence
  derived and/or modified sequence opt1 from hemagglutinin__InfluenzaB__ALN39775
augcaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucgugaucgacuacaugguccagaaguccgggaagacgggcaccaucaccuaccagcgcggcauccuccugccccagaagguguggugcgugagcgggcgguccaaggucaucaagggcagccugccccucaucggggaggccgacugccugcacgagaaguacggcgggcugaacaagagcaagcccuacuacaccggcgagcacgccaaggcggugggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggaccuucgacgccggcgaguucucccuccccacguucgacagccugaacaucaccgcggccucccugaacgacgacggccucgacaaccacaccauccugcuguacuacagcaccgccgccuccagccuggccgugacgcucaugaucgcgaucuucguggucuacauggugucccgcgacaacgugagcugcuccaucugccuguga

SEQ ID NO: 89504 - RNA, 1755 nt, Artificial Sequence
  derived and/or modified sequence opt1 from hemagglutinin__InfluenzaB__ALN39776
augaaggccaucaucauccugcucaugguggucaccagcaacgccgaccgcaucugcaccggcaucacguccagcaacagcccccacguggugaagaccgcgacccagggggaggucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcagacggucgaggugcccuacaucugcaccgagggcgaggaccagaucaccguguggggguuccacagcgacaacaagacccagaugaagucccuguacggcgacagcaacccccagaaguucacguccagcgccaacggggucaccacccacuacgugucccagaucggcgacuuccccgaccagaccgaggacggcgggcugccgcagagcggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccgucgacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucguguacauggucagccgggacaacguguccugcagcaucugccuguga

SEQ ID NO: 89505 - RNA, 1755 nt, Artificial Sequence; identical to SEQ ID NO: 89460
  derived and/or modified sequence opt1 from hemagglutinin__InfluenzaB__ALN39778

SEQ ID NO: 89506 - RNA, 1758 nt, Artificial Sequence; identical to SEQ ID NO: 89483
  derived and/or modified sequence opt1 from hemagglutinin__InfluenzaB__ALN39779

SEQ ID NO: 89507 - RNA, 1755 nt, Artificial Sequence; identical to SEQ ID NO: 89297
  derived and/or modified sequence opt1 from hemagglutinin__InfluenzaB__ALN39780

SEQ ID NO: 89508 - RNA, 1758 nt, Artificial Sequence; identical to SEQ ID NO: 89483
  derived and/or modified sequence opt1 from hemagglutinin__InfluenzaB__ALN39781

SEQ ID NO: 89509 - RNA, 1758 nt, Artificial Sequence; identical to SEQ ID NO: 89447
  derived and/or modified sequence opt1 from hemagglutinin__InfluenzaB__ALN39782

SEQ ID NO: 89510 - RNA, 1755 nt, Artificial Sequence
  derived and/or modified sequence opt1 from hemagglutinin__InfluenzaB__ALN39783
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaaccugcagacgguggaggugccguacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccccagagcggccgcaucgucguggacuacauggugcagaagccggggaagacgggcaccaucgucuaccagcgcggggugcugcugccccagaagguguggugcgccuccggccggagcaaggucaucaagggcagccucccccugaucggggaggcggacugccugcacgaggaguacggcgggcucaacaaguccaagcccuacuacaccggcaagcacgccaaggccaucgggaacugcccgaucugggugaagacgccccugaagcuggccaacggcaccaaguaccggccgcccgccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgccgacacgaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgucacccugaugcuggccaucuucaucguguacauggugagccgggacaacgucuccugcagcaucugccucuga

SEQ ID NO: 89511 - RNA, 1758 nt, Artificial Sequence; identical to SEQ ID NO: 89459
  derived and/or modified sequence opt1 from hemagglutinin__InfluenzaB__ALN39784

SEQ ID NO: 89512 - RNA, 1758 nt, Artificial Sequence; identical to SEQ ID NO: 89483
  derived and/or modified sequence opt1 from hemagglutinin__InfluenzaB__ALN39785

SEQ ID NO: 89513 - RNA, 1755 nt, Artificial Sequence; identical to SEQ ID NO: 89297
  derived and/or modified sequence opt1 from hemagglutinin__InfluenzaB__ALN39786

SEQ ID NO: 89514 - RNA, 1758 nt, Artificial Sequence; identical to SEQ ID NO: 89483
  derived and/or modified sequence opt1 from hemagglutinin__InfluenzaB__ALN39787

SEQ ID NO: 89515 - RNA, 1758 nt, Artificial Sequence; identical to SEQ ID NO: 89483
  derived and/or modified sequence opt1 from hemagglutinin__InfluenzaB__ALN39788

SEQ ID NO: 89516 - RNA, 1755 nt, Artificial Sequence
  derived and/or modified sequence opt1 from hemagglutinin__InfluenzaB__ALN39790
augaaggccaucaucgugcugcucauggucgugaccagcgacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagcgcuucacguccagcgccaacggggugaccacccacuacgugucccagaucggcgacuuccccgaccagaccgaggacggcgggcugccgcagagcggccggaucgucguggacuacauggugcagaagcccgggaagacgggcaccaucgucuaccagcgcggggugcuccugccccagaagguguggugcgccuccggccggagcaaggucaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggugaagaaccuccagcgccugagcggggccauggacgagcugcacaacgagauccucgagcuggacgagaaggucgacgaccugcgggccgacacgaucuccagccagaucgagcucgcggugcugcuguccaacgagggcaucaucaacagcgaggacgagcaccuccuggcccuggagcgcaagcucaagaagaugcugggccccuccgccguggacaucgggaacggcugcuucgagaccaagcacaagugcaaccagaccugccuggaccggaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgucacccucaugcuggccaucuucaucguguacauggugagccgcgacaacgucuccugcagcaucugccuguga

SEQ ID NO: 89517 - RNA, 1755 nt, Artificial Sequence
  derived and/or modified sequence opt1 from hemagglutinin__InfluenzaB__ALN39791
augaaggccaucaucgugcugcucauggucgugaugagcaacgccgaccgcaucugcaccggcaucaccuccagcaacagcccccacguggucaagacggcgacccagggggaggugaacgugaccggcgucaucccgcugaccacgacccccaccaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaagauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcagaccguggaggugcccuacaucugcacggagggcgaggaccagaucaccgucuggggguuccacagcgacaacaagacccagaugaagucccuguacggcgacagcaacccccagaaguucaccuccagcgccaacggggugacgacccacuacgugucccagaucggcgacuuccccgaccagaccgaggacggcgggcugccgcagagcggccgcaucgucguggacuacauggugcagaagcccgggaagaccggcacgaucgucuaccagcgcggggugcuccugccccagaagguguggugcgccuccggccggagcaaggucaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaaggucgacgaccugcgcgccgacaccaucuccagccagaucgagcucgcggugcugcuguccaacgagggcaucaucaacagcgaggacgagcaccuccuggcccuggagcggaagcucaagaagaugcugggccccuccgccguggacaucgggaacggcugcuucgagacgaagcacaagugcaaccagaccugccuggaccgcaucgccgcggggaccuucaacgccggcgaguucagccuccccaccuucgacucccugaacaucaccgccgccagccugaacgacgacgggcucgacaaccacacgauccugcuguacuacuccaccgccgcgagcucccuggccgucacccucaugcuggccaucuucaucguguacauggugagccgggacaacgucuccugcagcaucugccuguga

SEQ ID NO: 89518 - RNA, 1758 nt, Artificial Sequence; identical to SEQ ID NO: 89483
  derived and/or modified sequence opt1 from hemagglutinin__InfluenzaB__ALN39792

SEQ ID NO: 89519 - RNA, 1758 nt, Artificial Sequence; identical to SEQ ID NO: 89483
  derived and/or modified sequence opt1 from hemagglutinin__InfluenzaB__ALN39793

SEQ ID NO: 89520 - RNA, 1755 nt, Artificial Sequence
  derived and/or modified sequence opt1 from hemagglutinin__InfluenzaB__ALN39794
augaaggccaucaucauccugcucaugguggucaccagcaacgccgaccgcaucugcaccggcaucacguccagcaacagcccccacguggugaagaccgcgacccagggggaggucaacgugaccggcgugaucccgcugacgaccacccccaccaaguccuacuucgccaaccugaaggggacgcggacccgcggcaagcucugccccgacugccugaacugcaccgaccuggacgucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcagacggucgaggugcccuacaucugcaccgagggcgaggaccagaucaccguguggggguuccacagcgacaacaagacccagaugaagucccuguacggcgacagcaacccccagaaguucacguccagcgccgacggggucaccacccacuacgugucccagaucggcgacuuccccgaccagaccgaggacggcgggcugccgcagagcggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacacgaucuccagccagaucgagcucgcggugcugcuguccaacgagggcaucaucaacagcgaggacgagcaccuccuggcccuggagcggaagcucaagaagaugcugggccccuccgccgucgacaucgggaacggcugcuucgagaccaagcacaagugcaaccagaccugccuggaccgcaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucguguacauggucagccgggacaacguguccugcagcaucugccuguga

SEQ ID NO: 89521 - RNA, 1755 nt, Artificial Sequence; identical to SEQ ID NO: 89460
  derived and/or modified sequence opt1 from hemagglutinin__InfluenzaB__ALN39795

SEQ ID NO: 89522 - RNA, 1758 nt, Artificial Sequence
  derived and/or modified sequence opt1 from hemagglutinin__InfluenzaB__ALN39796
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgccacgaacggcaacggcuucuucgccaccauggccugggcgguccccaagaacgacaagaacaagaccgccaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccagcgggcgguccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucagcucccagaucgagcucgcggugcugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccacguucgacagccugaacaucaccgccgccucccugaacgacgacggccucgacaaccacaccauccugcuguacuacagcaccgccgcguccagccuggccgucacgcucaugaucgccaucuucgugguguacauggucucccgcgacaacgugagcugcuccaucugccuguga

SEQ ID NO: 89523 - RNA, 1755 nt, Artificial Sequence; identical to SEQ ID NO: 89460
  derived and/or modified sequence opt1 from hemagglutinin__InfluenzaB__ALN39797

SEQ ID NO: 89524 - RNA, 1755 nt, Artificial Sequence
  derived and/or modified sequence opt1 from hemagglutinin__InfluenzaB__ALN39798
augaaggccaucaucgugcugcucauggucgugaccagcaacgccgaccgcaucugcaccggcaucacguccagcuccagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccgagcgccaaggccuccauccugcacgagguccgccccgugaccagcggcugcuuccccaucaugcacgaccggaccaagauccgccagcugcccaaccuccugcggggguacgagaagauccgccuguccacccagaacgugaucgacgcggagaaggccccgggcgggcccuaccggcucggcacgagcggguccugccccaacgccaccagcaagaucggcuucuucgccaccauggcgugggccguccccaaggacaacuacaagaacgccaccaacccgcagacgguggaggugcccuacaucugcaccgagggcgaggaccagaucaccgucuggggguuccacuccgacaacaagacccagaugaagucccuguacggcgacagcaacccccagaaguucacgagcuccgccaacggggugaccacccacuacgugagccagaucggcgacuuccccgaccagaccgaggacggcgggcugccgcaguccggccgcaucgucguggacuacaugaugcagaagcccgggaagacgggcaccaucguguaccagcgcgggguccuccugccccagaagguguggugcgccagcggccggagcaaggugaucaagggcucccugccccucaucggggaggcggacugccugcacgaggaguacggcgggcugaacaagagcaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcuggaggugaagaaccuccagcggcuguccggggccauggacgagcugcacaacgagauccucgagcuggacgagaagguggacgaccugcgcgccgacacgaucagcucccagaucgagcucgcgguccugcugagcaacgagggcaucaucaacuccgaggacgagcaccuccuggcccuggagcggaagcucaagaagaugcugggccccagcgccguggacaucgggaacggcugcuucgagaccaagcacaagugcaaccagaccugccuggaccgcaucgccgcggggaccuucaacgccggcgaguucucccuccccaccuucgacagccugaacaucacggccgccucccugaacgacgacgggcucgacaaccacaccauccugcuguacuacagcaccgccgcguccagccuggccgugacccucaugcuggccaucuucaucgucuacauggugucccgggacaacgugagcugcagcaucugccuguga

SEQ ID NO: 89525 - RNA, 1755 nt, Artificial Sequence; identical to SEQ ID NO: 89297
  derived and/or modified sequence opt1 from hemagglutinin__InfluenzaB__ALN39799

SEQ ID NO: 89526 - RNA, 1755 nt, Artificial Sequence
  derived and/or modified sequence opt1 from hemagglutinin__InfluenzaB__ALN39800
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacacgaucuccagccagaucgagcucgcgguccugcuguccaacgagggcaucaucaacagcgaggacgagcaccuccuggcccuggagaagaagcucaagaagaugcugggccccuccgccguggacaucgggaacggcugcuucgagaccaagcacaagugcaaccagaccugccuggaccggaucgccgcggggaccuucaacgccggcgaguucagccuccccaccuucgacucccugaacaucacggccgccagccugaacgacgacgggcucgacaaccacaccauccugcuguacuacuccaccgccgcgagcucccuggccgugacccucaugcuggccaucuucaucgucuacauggugagccgcgacaacguguccugcagcaucugccuguga

SEQ ID NO: 89527 - RNA, 1755 nt, Artificial Sequence; identical to SEQ ID NO: 89517
  derived and/or modified sequence opt1 from hemagglutinin__InfluenzaB__ALN39801

SEQ ID NO: 89528 - RNA, 1755 nt, Artificial Sequence; identical to SEQ ID NO: 89460
  derived and/or modified sequence opt1 from hemagglutinin__InfluenzaB__ALN39802

SEQ ID NO: 89529 - RNA, 1755 nt, Artificial Sequence; identical to SEQ ID NO: 89517
  derived and/or modified sequence opt1 from hemagglutinin__InfluenzaB__ALN39803

SEQ ID NO: 89530 - RNA, 1755 nt, Artificial Sequence; identical to SEQ ID NO: 89456
  derived and/or modified sequence opt1 from hemagglutinin__InfluenzaB__ALN39804

SEQ ID NO: 89531 - RNA, 1758 nt, Artificial Sequence; identical to SEQ ID NO: 89483
  derived and/or modified sequence opt1 from hemagglutinin__InfluenzaB__ALN39805

SEQ ID NO: 89532 - RNA, 1758 nt, Artificial Sequence; identical to SEQ ID NO: 87997
  derived and/or modified sequence opt1 from hemagglutinin__InfluenzaB__ACN29380

SEQ ID NO: 89533 - RNA, 1758 nt, Artificial Sequence; identical to SEQ ID NO: 88329
  derived and/or modified sequence opt1 from hemagglutinin__InfluenzaB__EPI498048

SEQ ID NO: 89534 - RNA, 1758 nt, Artificial Sequence
  derived and/or modified sequence opt1 from hemagglutinin__InfluenzaB__ANC28539
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgaggcccagauggccaagcuguacggggacagcaagccccagaaguucaccuccagcgccaacggcgucacgacccacuacgugucccagaucggcggguuccccaaccagaccgaggacggcgggcugccgcagagcggccggaucguggucgacuacauggugcagaaguccgggaagaccggcacgaucaccuaccagcgcggcauccuccugccccagaagguguggugcgccagcgggcgguccaaggucaucaagggcagccugccccucaucggggaggcggacugccugcacgagaaguacggcgggcugaacaagagcaagcccuacuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucagcucccagaucgagcucgcggugcugcugagcaacgaggggaucaucaacuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuucgacgccggcgaguucucccuccccaccuucgacagccugaacaucacggccgccucccugaacgacgacggccucgacaaccacaccauccugcuguacuacagcaccgccgcguccagccuggccgucacccucaugaucgccaucuucgugguguacauggucucccgcgacaacgugagcugcuccaucugccuguga

SEQ ID NO: 89535 - RNA, 1758 nt, Artificial Sequence
  derived and/or modified sequence opt1 from hemagglutinin__InfluenzaB__EPI827073
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggccugcacuccgacaacgagauccagauggccaagcuguacggggacagcaagccccagaaguucaccuccagcgccaacggcgucacgacccacuacgugucccagaucggcggguuccccaaccagaccgaggacggcgggcucccgcagagcggccggaucguggucgacuacauggugcagaaguccgggaagaccggcacgaucaccuaccagcgcggcauccugcugccccagaagguguggugcgccagcgggcgguccaaggucaucaagggcagccucccccugaucggggaggccgacugccugcacgagaaguacggcgggcucaacaagagcaagcccuacuacaccggcgagcacgcgaaggccaucggcaacugcccgaucugggugaagacgccccugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcguggccgucgccgcggaccucaagagcacccaggaggccaucaacaagaucaccaagaaccugaacucccugagcgagcucgaggugaagaaccugcagcgccuguccggcgccauggacgagcuccacaacgagauccuggagcuggacgagaaggucgacgaccuccgggccgacacgaucagcucccagaucgagcuggccgugcugcucagcaacgaggggaucaucaacuccgaggacgagcaccuccuggcgcuggagcgcaagcugaagaagaugcugggccccagcgccguggagaucgggaacggcugcuucgagaccaagcacaagugcaaccagaccugccucgaccggaucgccgccgggaccuucgacgcgggcgaguucucccugcccaccuucgacagccugaacaucacggccgccucccucaacgacgacggccuggacaaccacaccauccugcuguacuacagcaccgccgccuccagccucgcggucacccugaugaucgccaucuucgugguguacauggucucccgcgacaacgugagcugcuccaucugccuguga

SEQ ID NO: 89536 - RNA, 1758 nt, Artificial Sequence; identical to SEQ ID NO: 87755
  derived and/or modified sequence opt1 from hemagglutinin__InfluenzaB__EPI244699

SEQ ID NO: 89537 - RNA, 1758 nt, Artificial Sequence; identical to SEQ ID NO: 87748
  derived and/or modified sequence opt1 from hemagglutinin__InfluenzaB__EPI244702

SEQ ID NO: 89538 - RNA, 1755 nt, Artificial Sequence; identical to SEQ ID NO: 89137
  derived and/or modified sequence opt1 from hemagglutinin__InfluenzaB__EPI540671

SEQ ID NO: 89539 - RNA, 1755 nt, Artificial Sequence
  derived and/or modified sequence opt1 from hemagglutinin__InfluenzaB__EPI573303
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89540 - RNA, 1755 nt, Artificial Sequence
  derived and/or modified sequence opt1 from hemagglutinin__InfluenzaB__EPI829466
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgacaagacccagaugaagucccuguacggcgacagcaacccccagaaguucacguccagcgccaacggggugaccacccacuacgugucccagaucggcgacuuccccgaccagaccgaggacgagggccucccgcagagcgggcgcaucgucguggacuacaugaugcagaagcccggcaagacggggaccaucguguaccagcggggcguccugcugccccagaagguguggugcgccuccgggcgcagcaaggugaucaagggcagccucccccugaucggcgaggcggacugccugcacgaggaguacgggggccucaacaaguccaagccguacuacaccgggaagcacgccaaggccaucggcaacugccccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccagccacggcgcccacgggguggccgucgcggccgaccucaaguccacccaggaggccaucaacaagaucaccaagaaccugaacagccuguccgagcucgaggugaagaaccugcagcggcugagcggcgccauggacgagcuccacaacgagauccuggagcuggacgagaagguggacgaccuccgcgccgacacgaucuccagccagaucgagcuggcgguccugcucuccaacgaggggaucaucaacagcgaggacgagcaccuccuggcccuggagcggaagcugaagaagaugcugggccccuccgccguggacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89541 - RNA, 1755 nt, Artificial Sequence
  derived and/or modified sequence opt1 from hemagglutinin__InfluenzaB__EPI684429
augaaggccaucaucgugcugcucauggucgugaugagcaacgccgaccgcaucugcaccggcaucaccuccagcaacagcccccacguggucaagacggcgacccagggggaggugaacgugaccggcgucaucccgcugaccacgacccccaccaaguccuacuucgccaaccugaaggggacccggacgcgcggcaagcucugccccgacugccugaacugcaccgaccuggacguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguacgagaagauccgccugagcacccagaacgugaucgacgcggagaaggccccgggcgggcccuaccggcucggcaccuccgggagcugccccaacgccacguccaagaucggcuucuucgccaccauggcgugggccguccccaaggacaacuacaagaacgccaccaacccgcagaccguggaggugcccuacaucugcacggagggcgaggaccagaucaccgucuggggguuccacagcgacaacaagacccagaugaagucccuguacggcgacagcaacccccagaaguucaccuccagcgccaacggggugacgacccacuacgugucccagaucggcgacuuccccgaccagaccgaggacggcgggcugccgcagagcggccgcaucgucguggacuacauggugcagaagcccgggaagaccggcacgaucgucuaccagcgcggggugcuccugccccagaagguguggugcgucuccggccggagcaaggugaucaagggcagccugccccucaucggggaggccgacugccugcacgaggaguacggcgggcugaacaaguccaagccguacuacaccggcaagcacgcgaaggccaucgggaacugccccaucugggucaagacgccccucaagcuggccaacggcaccaaguaccggcccccggccaagcugcucaaggagcgcggcuucuucggggccaucgcgggcuuccuggagggcgggugggaggggaugaucgccggcuggcacggcuacaccagccacggggcccacggcguggccguggccgcggaccugaaguccacccaggaggccaucaacaagaucaccaagaaccucaacagccuguccgagcuggaggucaagaaccuccagcggcugagcggggccauggacgagcugcacaacgagauccucgagcuggacgagaagguggacgaccugcgcgccgacaccaucuccagccagaucgagcucgccgugcugcuguccaacgagggcaucaucaacagcgaggacgagcaccuccuggcgcuggagcggaagcucaagaagaugcugggccccuccgccgucgacaucgggaacggcugcuucgagacgaagcacaagugcaaccagaccugccuggaccgcaucgccgccgggaccuucaacgcgggcgaguucagccuccccaccuucgacucccugaacaucaccgccgccagccugaacgacgacgggcucgacaaccacacgauccugcuguacuacuccaccgccgccagcucccuggcggugacccucaugcuggccaucuucaucguguacauggucagccgggacaacguguccugcagcaucugccuguga

SEQ ID NO: 89542 - RNA, 1758 nt, Artificial Sequence; identical to SEQ ID NO: 87760
  derived and/or modified sequence opt1 from hemagglutinin__InfluenzaB__AFH58447

SEQ ID NO: 89543 - RNA, 1758 nt, Artificial Sequence
  derived and/or modified sequence opt1 from hemagglutinin__InfluenzaB__EPI173279
augaaggccaucaucgugauccugauggucgugaccagcaacgccgaccgcaucugcaccggcaucacguccagcaacagcccccacguggucaagaccgcgacccagggggaggugaacgugaccggcgucaucccgcucacgaccacccccaccaagagccacuucgccaaccugaaggggacggagacccggggcaagcugugccccaagugccucaacugcaccgaccuggacguggcccuggggcgccccaagugcaccggcaagaucccguccgcccgggugagcauccuccacgagguccgccccgugacguccggcugcuuccccaucaugcacgaccggaccaagauccgccagcugcccaaccugcuccggggguacgagcacauccgccugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcugacgaucgaggugcccuacaucugcaccgagggggaggaccagaucaccguguggggcuuccacuccgacagcgagacccagauggccaagcucuacggggacuccaagccccagaaguucacgagcuccgccaacggcgucaccacccacuacgugagccagaucggcggguuccccaaccagaccgaggacggcgggcugccgcaguccggccggaucguggucgacuacauggugcagaaguccgggaagacgggcaccaucaccuaccagcgcggcauccugcucccccagaagguguggugcgccuccgggcggagcaaggucaucaagggcagccugccccugaucggggaggccgacugccuccacgagaaguacggcgggcugaacaaguccaagcccuacuacaccggcgagcacgcgaaggccaucggcaacugcccgaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccagccacggggcccacggcguggccgucgccgcggaccugaaguccacccaggaggccaucaacaagaucacgaagaaccugaacagccucuccgagcuggaggugaagaaccugcagcgccucagcggcgccauggacgagcugcacaacgagauccuggagcucgacgagaaggucgacgaccugcgggccgacaccaucuccagccagaucgagcuggccgugcuccuguccaacgaggggaucaucaacagcgaggacgagcaccuccuggcgcuggagcgcaagcugaagaagaugcucggccccuccgccguggagaucgggaacggcugcuucgagaccaagcacaagugcaaccagaccugccuggaccggaucgccgccgggaccuucgacgcgggcgaguucagccugcccacguucgacucccucaacaucaccgccgccagccugaacgacgacggccuggacaaccacaccauccuccuguacuacuccaccgccgccagcucccuggcggucacgcugaugaucgccaucuucgugguguacauggucagccgcgacaacguguccugcagcaucugccucuga

SEQ ID NO: 89544 - RNA, 1758 nt, Artificial Sequence; identical to SEQ ID NO: 88329
  derived and/or modified sequence opt1 from hemagglutinin__InfluenzaB__EPI163726

SEQ ID NO: 89545 - RNA, 1758 nt, Artificial Sequence; identical to SEQ ID NO: 89483
  derived and/or modified sequence opt1 from hemagglutinin__InfluenzaB__EPI636340

SEQ ID NO: 89546 - RNA, 1758 nt, Artificial Sequence
  derived and/or modified sequence opt1 from hemagglutinin__InfluenzaB__EPI645995
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccuccgggagcugccccaacaucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacgacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89547 - RNA, 1755 nt, Artificial Sequence; identical to SEQ ID NO: 89137
  derived and/or modified sequence opt1 from hemagglutinin__InfluenzaB__EPI539769

SEQ ID NO: 89548 - RNA, 1755 nt, Artificial Sequence; identical to SEQ ID NO: 89539
  derived and/or modified sequence opt1 from hemagglutinin__InfluenzaB__EPI551249

SEQ ID NO: 89549 - RNA, 1755 nt, Artificial Sequence
  derived and/or modified sequence opt1 from hemagglutinin__InfluenzaB__EPI544259
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagaaccagaugaagucccuguacggcgacagcaacccccagaaguucaccuccagcgccaacggggugacgacccacuacgugucccagaucggcgacuuccccgaccagaccgaggacggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagacgaagcacaagugcaaccagaccugccucgaccgcaucgccgcggggaccuucaacgccggcgaguucagccugcccaccuucgacucccugaacaucaccgccgccagccucaacgacgacgggcuggacaaccacacgauccugcuguacuacuccaccgccgcgagcucccucgccgugacccugaugcuggccaucuucaucgucuacauggugagccgggacaacguguccugcagcaucugccucuga

SEQ ID NO: 89550 - RNA, 1755 nt, Artificial Sequence
  derived and/or modified sequence opt1 from hemagglutinin__InfluenzaB__EPI592699
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagauccagaugaagucccuguacggcgacagcaacccccagaaguucaccuccagcgccaacggggugacgacccacuacgugucccagaucggcgacuuccccgaccagaccgaggacggcgggcugccgcagagcggccgcaucgucguggacuacauggugcagaagcccgggaagaccggcacgaucgucuaccagcgcggggugcuccugccccagaagguguggugcgccuccggccggagcaaggucaucaagggcagccugccccucaucggggaggcggacugccugcacgaggaguacggcgggcugaacaaguccaagccguacuacaccggcaagcacgccaaggccaucgggaacugccccaucugggugaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcgucgccguggcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaaggucgacgaccugcgcgccgacaccaucuccagccagaucgagcucgcggugcugcuguccaacgagggcaucaucaacagcgaggacgagcaccuccuggcccuggagcggaagcucaagaagaugcugggccccuccgccguggacaucgggaacggcugcuucgagacgaagcacaagugcaaccagaccugccuggaccgcaucgccgcggggaccuucaacgccggcgaguucagccuccccaccuucgacucccugaacaucaccgccgccagccugaacgacgacgggcucgacaaccacacgauccugcuguacuacuccaccgccgcgagcucccuggccgucacccucaugcuggccaucuucaucguguacauggugagccgggacaacgucuccugcagcaucugccuguga

SEQ ID NO: 89551 - RNA, 1755 nt, Artificial Sequence; identical to SEQ ID NO: 89460
  derived and/or modified sequence opt1 from hemagglutinin__InfluenzaB__EPI592707

SEQ ID NO: 89552 - RNA, 1755 nt, Artificial Sequence
  derived and/or modified sequence opt1 from hemagglutinin__InfluenzaB__EPI693094
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgagagcugccccaacgccaccuccaagaucggguucuucgccaccauggcgugggccguccccaaggacaacuacaagaacgccaccaacccgcagacgguggaggugcccuacaucugcaccgagggcgaggaccagaucaccgucuggggcuuccacagcgacaacaagauccagaugaagucccuguacggggacagcaacccccagaaguucaccuccagcgccaacggcgugacgacccacuacgugucccagaucggggacuuccccgaccagaccgaggacggcggccugccgcagagcgggcgcaucgucguggacuacauggugcagaagcccggcaagaccgggacgaucgucuaccagcggggcgugcuccugccccagaagguguggugcgccuccgggcgcagcaaggucaucaagggcagccugccccucaucggcgaggcggacugccugcacgaggaguacgggggccugaacaaguccaagccguacuacaccgggaagcacgccaaggccaucggcaacugccccaucugggugaagacgccccucaagcuggccaacgggaccaaguaccggcccccggccaagcugcucaaggagcgcggcuucuucggcgcgaucgccggguuccuggagggcgggugggagggcaugaucgccggguggcacggcuacaccagccacggcgcccacggggucgccguggcggccgaccugaaguccacccaggaggccaucaacaagaucaccaagaaccucaacagccuguccgagcuggaggugaagaaccuccagcggcugagcggcgccauggacgagcugcacaacgagauccucgagcuggacgagaaggucgacgaccugcgcgccgacaccaucuccagccagaucgagcucgcggugcugcuguccaacgaggggaucaucaacagcgaggacgagcaccuccuggcccuggagcggaagcucaagaagaugcugggccccuccgccguggacaucggcaacgggugcuucgagacgaagcacaagugcaaccagaccugccuggaccgcaucgccgcgggcaccuucaacgccggggaguucagccuccccaccuucgacucccugaacaucaccgccgccagccugaacgacgacggccucgacaaccacacgauccugcuguacuacuccaccgccgcgagcucccuggccgucacccucaugcuggccaucuucaucguguacauggugagccgggacaacgucuccugcagcaucugccuguga

SEQ ID NO: 89553 - RNA, 1758 nt, Artificial Sequence; identical to SEQ ID NO: 89483
  derived and/or modified sequence opt1 from hemagglutinin__InfluenzaB__EPI678796

SEQ ID NO: 89554 - RNA, 1758 nt, Artificial Sequence
  derived and/or modified sequence opt1 from hemagglutinin__InfluenzaB__EPI721064
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacgugcgccugagcacccacaacgucaucaacgccgaggacgcgccgggcgggcccuacaagaucggcaccucccggagcugccccaacaucacgaacgggaacggcuucuucgccaccauggccugggccgugcccaagaacgacaagaacaagaccgcgaccaacccgcucacgaucgaggugcccuacaucugcaccgagggcgaggaccagaucaccgucuggggguuccacuccgacaacgagacccagauggccaagcuguacggcgacagcaagccccagaaguucacguccagcgccaacggggugaccacccacuacgugucccagaucggcggcuuccccaaccagaccgaggacgggggccugccgcagagcgggcgcaucgucguggacuacauggugcagaaguccggcaagacggggaccaucaccuaccagcggggcauccuccugccccagaaggucuggugcgccagcggccgcuccaaggugaucaaggggagccugccccucaucggcgaggccgacugccugcacgagaaguacgggggccugaacaagagcaagcccuacuacaccggggagcacgcgaaggccaucggcaacugcccgaucugggugaagacgccccucaagcuggccaacggcaccaaguaccggccgcccgccaagcugcucaaggagcgcggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucagcucccagaucgagcucgccgugcugcugagcaacgagggcaucaucaacuccgaggacgagcaccuccuggcgcuggagcggaagcucaagaagaugcuggggcccagcgccgucgagaucggcaacgggugcuucgagaccaagcacaagugcaaccagaccugccuggaccgcaucgccgccggcaccuucgacgcgggggaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgggacaacgugagcugcuccaucugccuguga

SEQ ID NO: 89555 - RNA, 1758 nt, Artificial Sequence; identical to SEQ ID NO: 87764
  derived and/or modified sequence opt1 from hemagglutinin__InfluenzaB__EPI328904

SEQ ID NO: 89556 - RNA, 1755 nt, Artificial Sequence
  derived and/or modified sequence opt1 from hemagglutinin__InfluenzaB__EPI543191
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaagaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89557 - RNA, 1755 nt, Artificial Sequence; identical to SEQ ID NO: 89137
  derived and/or modified sequence opt1 from hemagglutinin__InfluenzaB__EPI500359

SEQ ID NO: 89558 - RNA, 1755 nt, Artificial Sequence
  derived and/or modified sequence opt1 from hemagglutinin__InfluenzaB__EPI543185
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcagacgguggaggugcccuacaucugcaccgagggcgaggaccagaucaccgucuggggguuccacagcgacaacaagaaccagaugaagucccuguacggcgacagcaacccccagaaguucaccuccagcgccaacggggugacgacccacuacgugucccagaucggcgacuuccccgaccagaccgaggacggcgggcugccgcagagcggccgcaucgucguggacuacaugaugcagaagcccgggaagaccggcacgaucguguaccagcgcgggguccuccugccccagaagguguggugcgccuccggccggagcaaggugaucaagggcagccugccccucaucggggaggcggacugccugcacgaggaguacggcgggcugaacaaguccaagccguacuacaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuacaccagccacggggcccacggcguggccgucgcggccgaccugaaguccacccaggaggccaucaacaagaucaccaagaaccucaacagccuguccgagcuggaggugaagaaccuccagcggcugagcggggccauggacgagcugcacaacgagauccucgagcuggacgagaagguggacgaccugcgcgccgacaccaucuccagccagaucgagcucgcgguccugcuguccaacgagggcaucaucaacagcgaggacgagcaccuccuggcccuggagcggaagcucaagaagaugcugggccccuccgccguggacaucgggaacggcugcuucgagacgaagcacaagugcaaccagaccugccuggaccgcaucgccgcggggaccuucaacgccggcgaguucagccuccccaccuucgacucccugaacaucaccgccgccagccugaacgacgacgggcucgacaaccacacgauccugcuguacuacuccaccgccgcgagcucccuggccgugacccucaugcuggccaucuucaucgucuacauggugagccgggacaacguguccugcagcaucugccuguga

SEQ ID NO: 89559 - RNA, 1755 nt, Artificial Sequence; identical to SEQ ID NO: 89297
  derived and/or modified sequence opt1 from hemagglutinin__InfluenzaB__EPI536447

SEQ ID NO: 89560 - RNA, 1755 nt, Artificial Sequence; identical to SEQ ID NO: 87766
  derived and/or modified sequence opt1 from hemagglutinin__InfluenzaB__NP_056660

SEQ ID NO: 89561 - RNA, 1755 nt, Artificial Sequence
  derived and/or modified sequence opt1 from hemagglutinin__InfluenzaB__ABG85167
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccacccggucccacuucgccaaccugaaggggacgcagacccgcggcaagcucugccccaacugcuucaacugcaccgaccuggacguggcccuggggcggcccaagugcaugggcaacaucccguccgccaaggugagcauccuccacgaggucaagcccgugaccuccggcugcuuccccaucaugcacgaccgcacgaagauccggcagcugcccaaccugcuccgcggguacgagaacauccggcugagcaccuccaacgugaucaacgccgagaccgcgccgggcgggcccuacaaggucggcaccagcggguccugccccaacguggccaaccgcaacggcuucuucaacacgauggccugggugauccccaaggacaacaacaagaccgccaucaacccggucaccguggaggugcccuacaucugcagcgagggcgaggaccagaucaccgucuggggguuccacuccgacgacaagacgcagauggagcggcuguacggcgacagcaacccccagaaguucaccuccagcgcgaacggggugaccacccacuacgugucccagaucggcggcuuccccaaccagacggaggacgaggggcucaagcagagcggccgcaucgucguggacuacauggugcagaagccggggaagaccggcaccaucgucuaccagcgggggauccugcugccccagaagguguggugcgccuccggccgcagcaaggucaucaagggcagccucccccugaucggggaggccgacugccugcacgagaaguacggcgggcucaacaaguccaagcccuacuacaccggcgagcacgccaaggccaucgggaacugcccgaucugggugaagacgccccugaagcuggcgaacggcaccaaguaccggccgcccgccaagcuccugaaggagcgcggcuucuucggggccaucgccggcuuccuggagggcgggugggaggggaugaucgccggcuggcacggcuacaccagccacggggcgcacggcguggccgucgccgccgaccucaaguccacccaggaggccaucaacaagaucacgaagaaccugaacagccuguccgagcucgaggugaagaaccugcagcggcugagcggggcgaugaacggccuccacgacgagauccuggagcuggacgagaagguggacgaccuccgcgccgacaccaucuccagccagaucgagcuggccguccugcucuccaacgagggcaucaucaacagcgaggacgagcaccuccuggcccuggagcggaagcugaagaagaugcuggggcccuccgccguggagaucggcaacgggugcuucgagaccaagcacaagugcaaccagaccugccucgaccgcaucgcggccggcacguucaacgccggggacuucagccugcccaccuucgacucccugaacaucaccgccgcgagccucaacgacgacgaccuggacaaccacaccauccugcucuacuacuccaccgccgccagcucccuggccgugacgcugaugaucgccaucuucaucgucuacauggugagccgggacaacguguccugcagcaucugccuguga

SEQ ID NO: 89562 - RNA, 1755 nt, Artificial Sequence
  derived and/or modified sequence opt1 from hemagglutinin__InfluenzaB__EPI376346
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcgccgagggcgaggaccagaucaccgucuggggguuccacuccgacgacaagacccagaugaagaaccuguacggcgacagcaacccccagaaguucaccuccagcgcgaacggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagccacggcgcgcacgggguggccgucgccgccgaccucaaguccacccaggaggccaucaacaagaucaccaagaaccugaacagccuguccgagcucgaggugaagaaccugcagcgccugagcggcgcgauggacgagcuccacaacgagauccuggagcuggacgagaagguggacgaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggacaucggcaacgggugcuucgagacgaagcacaagugcaaccagaccugccucgaccggaucgccgccggcaccuucaacgccggggaguucagccugcccaccuucgacucccugaacaucaccgccgcgagccucaacgacgacggccuggacaaccacacgauccugcuguacuacuccaccgccgccagcucccucgccgugacccugaugcuggccaucuucaucgucuacauggugagccgcgacaacguguccugcagcaucugccucuga

SEQ ID NO: 89563 - RNA, 1755 nt, Artificial Sequence; identical to SEQ ID NO: 87862
  derived and/or modified sequence opt1 from hemagglutinin__InfluenzaB__EPI368425

SEQ ID NO: 89564 - RNA, 1755 nt, Artificial Sequence; identical to SEQ ID NO: 87828
  derived and/or modified sequence opt1 from hemagglutinin__InfluenzaB__ACH53430

SEQ ID NO: 89565 - RNA, 1758 nt, Artificial Sequence; identical to SEQ ID NO: 87653
  derived and/or modified sequence opt1 from hemagglutinin__InfluenzaB__EPI331151

SEQ ID NO: 89566 - RNA, 1758 nt, Artificial Sequence
  derived and/or modified sequence opt1 from hemagglutinin__InfluenzaB__EPI356777
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacgacgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89567 - RNA, 1752 nt, Artificial Sequence; identical to SEQ ID NO: 87435
  derived and/or modified sequence opt1 from hemagglutinin__InfluenzaB__CY018349

SEQ ID NO: 89568 - RNA, 1752 nt, Artificial Sequence
  derived and/or modified sequence opt1 from hemagglutinin__InfluenzaB__AY581945
augaaggccaucaucgugcugcucauggucgugaccagcaacgccgaccgcaucugcaccggcaucacguccagcaacuccccgcacguggucaagaccgcgacccagggggaggugaacgugaccggcgucaucccgcugacgaccacccccaccaagagccacuucgccaaccugaaggggacgaagacccggggcaagcucugccccaacugccugaacugcaccgaccuggacguggcccucgcccgccccaugugcguggggaccacgccguccgccaaggcgagcauccugcacgagguccggcccgugaccuccggcugcuuccccaucaugcacgaccgcaccaagauccggcagcugcccaaccuccugcgcggcuacgagaacauccggcugagcacccagaacgugaucaacgccgagcgcgcccccgggggccccuaccggcucgggacguccggcagcugccccaacgucaccucccgcgacggguucuucgccaccauggcgugggccgugccccgggacaacaagaccgccacgaacccgcugaccguggagguccccuacaucugcaccaagggcgaggaccagaucaccguguggggcuuccacagcgacaacaagacgcagaugaagaaccuguacggggacuccaacccccagaaguucaccagcuccgccaacggcgugaccacccacuacgucagccagaucgggggcuuccccaaccagacggaggacggcgggcucccgcaguccggccgcaucgugguggacuacaugguccagaagcccgggaagaccggcaccaucguguaccagcgcggggugcugcugccccagaaggucuggugcgccagcggccgguccaaggugaucaagggcagccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccguggcggccgaccucaagagcacccaggaggccaucaacaagaucacgaagaaccugaacucccugagcgagcucgaggucaagaaccugcagcggcuguccggggccauggacgagcuccacaacgagauccuggagcuggacgagaagguggacgaccuccgcgccgacaccaucagcucccagaucgagcuggcggugcugcucagcaacgagggcaucaucaacuccgaggacgagcaccuccuggcccuggagcggaagcugaagaagaugcugggccccagcgccgucgacaucgggaacggcugcuucgagaccaagcacaagugcaaccagaccugccucgaccgcaucgccgcggggaccuucaacgccggcgaguucucccugcccacguucgacagccugaacaucaccgccgccucccucaacgacgacgggcuggacaaccacaccauccugcuguacuacagcaccgccgcguccagccucgccgugacgcugaugaucgccaucuucaucguguacauggucucccgggacaacgugagcugcuccaucugccuguga

SEQ ID NO: 89569 - RNA, 1755 nt, Artificial Sequence; identical to SEQ ID NO: 89316
  derived and/or modified sequence opt1 from hemagglutinin__InfluenzaB__EPI541351

SEQ ID NO: 89570 - RNA, 1755 nt, Artificial Sequence
  derived and/or modified sequence opt1 from hemagglutinin__InfluenzaB__EPI541760
augaaggccgugaucguccugcucaugguggugaccagcaacgccgaccgcaucugcaccggcaucacguccagcaacagcccccacgucgugaagaccgcgacccagggggaggugaacgucaccggcgugaucccgcugacgaccacccccaccaaguccuacuucgccaaccugaaggggacgcggacccgcggcaagcucugccccgacugccugaacugcaccgaccuggacguggcccucgggcggcccaugugcgucggcaccacgccguccgccaaggccagcauccugcacgaggugcgccccgugaccuccggcugcuuccccaucaugcacgaccggaccaagauccgccagcugcccaaccuccugcggggguacgagaagauccgccugagcacccagaacgucaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcugacgguggagguccccuacaucugcaccgagggcgaggaccagaucaccguguggggguuccacagcgacaacaagacccagaugaagucccuguacggcgacagcaacccccagaaguucacguccagcgccaacggggugaccacccacuacgucucccagaucggcgacuuccccgaccagaccgaggacggcgggcucccgcagagcggccgcaucgugguggacuacaugaugcagaagcccgggaagacgggcaccaucgucuaccagcgcggggugcugcugccccagaagguguggugcgccuccggccggagcaaggucaucaagggcagccucccccugaucggggaggcggacugccugcacgaggaguacggcgggcucaacaaguccaagccguacuacaccggcaagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaaggucgacgaccuccgcgccgacacgaucuccagccagaucgagcuggcggugcugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgucacccugaugcuggccaucuucaucguguacauggugagccgggacaacgucuccugcagcaucugccucuga

SEQ ID NO: 89571 - RNA, 1758 nt, Artificial Sequence; identical to SEQ ID NO: 87895
  derived and/or modified sequence opt1 from hemagglutinin__InfluenzaB__EPI477397

SEQ ID NO: 89572 - RNA, 1758 nt, Artificial Sequence
  derived and/or modified sequence opt1 from hemagglutinin__InfluenzaB__EPI492571
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaucgagacccagauggccaagcuguacggggacagcaagccccagaaguucacguccagcgccaacggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccacguucgacagccugaacaucaccgccgccucccugaacgacgacggccucgacaaccacaccauccugcuguacuacagcaccgccgccuccagccuggcggugacgcucaugaucgccaucuucguggucuacauggugucccgcgacaacgugagcugcuccaucugccuguga

SEQ ID NO: 89573 - RNA, 1758 nt, Artificial Sequence
  derived and/or modified sequence opt1 from hemagglutinin__InfluenzaB__EPI498340
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacaccgaggacgccccgggcgggcccuacaagaucggcacguccgggagcugccccaacgucaccaacggcaacggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaucgagacgcagauggcgaagcuguacggggacagcaagccccagaaguucaccuccagcgccaacggcgugaccacccacuacgugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucagcucccagaucgagcucgccgugcugcugagcaacgaggggaucaucaacuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguucgacgccggcgaguucucccuccccaccuucgacagccugaacaucaccgcggccucccugaacgacgacggccucgacaaccacaccauccugcuguacuacagcacggccgccuccagccuggccgugacccucaugaucgcgaucuucguggucuacauggugucccgcgacaacgugagcugcuccaucugccuguga

SEQ ID NO: 89574 - RNA, 1758 nt, Artificial Sequence
  derived and/or modified sequence opt1 from hemagglutinin__InfluenzaB__EPI516490
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgaggacgcgccgggcgggcccuacaagaucggcaccuccgggagcugccccaacgucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagauccagauggccaagcuguacggggacagcaagccccagaaguucaccuccagcgccaacggcgugacgacccacuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccagcgggcgguccaaggugaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucagcucccagaucgagcucgccgugcugcugagcaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuucgacgcgggcgaguucucccuccccaccuucgacagccugaacaucacggccgccucccugaacgacgacggccucgacaaccacaccauccugcuguacuacagcaccgccgccuccagccuggcggugacccucaugaucgccaucuucguggucuacauggugucccgcgacaacgugagcugcuccaucugccuguga

SEQ ID NO: 89575 - RNA, 1755 nt, Artificial Sequence; identical to SEQ ID NO: 89137
  derived and/or modified sequence opt1 from hemagglutinin__InfluenzaB__EPI538119

SEQ ID NO: 89576 - RNA, 1755 nt, Artificial Sequence; identical to SEQ ID NO: 89556
  derived and/or modified sequence opt1 from hemagglutinin__InfluenzaB__EPI538125

SEQ ID NO: 89577 - RNA, 1755 nt, Artificial Sequence
  derived and/or modified sequence opt1 from hemagglutinin__InfluenzaB__EPI556422
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaucaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89578 - RNA, 1755 nt, Artificial Sequence
  derived and/or modified sequence opt1 from hemagglutinin__InfluenzaB__EPI614608
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccaucaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccgugcccaaggacaacuacaagaacgccaccaacccgcugacggucgaggugcccuacaucugcaccgagggcgaggaccagaucaccguguggggguuccacagcgacgagaagacccagaugaagucccuguacggcgacagcaacccccagaaguucacguccagcgccaacggggucaccacccacuacgugucccagaucggcgacuuccccgaccagaccgaggacggcgggcucccgcagagcggccgcaucguggucgacuacaugaugcagaagcccgggaagacgggcaccaucguguaccagcgcggggugcugcugccccagaaggucuggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcgucgccguggcggccgaccucaaguccacccaggaggccaucaacaagaucaccaagaaccugaacagccuguccgagcucgaggucaagaaccugcagcggcugagcggggccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcugggccccuccgccgucgacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucguguacauggucagccgggacaacguguccugcagcaucugccucuga

SEQ ID NO: 89579 - RNA, 1755 nt, Artificial Sequence
  derived and/or modified sequence opt1 from hemagglutinin__InfluenzaB__EPI614610
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacgagaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgaggaguacggcgggcucaacaaguccaagccguacuacaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89580 - RNA, 1758 nt, Artificial Sequence
  derived and/or modified sequence opt1 from hemagglutinin__InfluenzaB__AAA43697
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgcccgccccaagugcauggggaccaucccguccgccaaggcgagcauccugcacgaggugaagcccgucacguccggcugcuuccccaucaugcacgaccggaccaagauccgccagcugcccaaccuccugcggggcuacgagcacauccgccugagcacccacaacgugaucaacgccgagaccgcccccgggggccccuacaagguggggacguccggcagcugccccaacgucaccaacgggaacggcuucuucgccaccauggcgugggccgugcccaagaacgacaacaacaagaccgccacgaacccgcucaccguggagguccccuacaucugcaccgagggcgaggaccagaucaccguguggggguuccacuccgacagcgagacgcagauggugaagcuguacggcgacuccaagccccagaaguucaccagcuccgccaacggggucaccacccacuacgugagccagaucggcggcuuccccaaccaggccgaggacgggggccugccgcaguccgggcggaucguggucgacuacauggugcagaaguccggcaagacggggaccaucaccuaccagcgcggcauccuccugccccagaagguguggugcgcguccggccggagcaaggucaucaaggggagccugccccucaucggcgaggccgacugccugcacgagaaguacgggggccugaacaaguccaagcccuacuacaccggggagcacgccaaggccaucggcaacugcccgaucugggugaagacgccccucaagcuggccaacggcaccaaguaccgcccgcccgcgaagcugcucaaggagcggggguucuucggcgccaucgccggguuccuggagggcgggugggagggcaugaucgccggcuggcacggguacaccagccacggcgcccacggggucgcgguggccgccgaccugaaguccacccaggaggccaucaacaagaucacgaagaaccucaacagccuguccgagcuggaggugaagaaccuccagcgccugagcggcgccauggacgagcugcacaacgagauccucgagcuggacgagaaggucgacgaccugcgggcggacaccaucuccagccagaucgagcucgccgugcugcuguccaacgagggcaucaucaacagcgaggacgagcaccuccuggcccuggagcgcaagcucaagaagaugcuggggccguccgccguggagaucggcaacgggugcuucgagaccaagcacaagugcaaccagaccugccuggaccggaucgcggccggcaccuucaacgccggggaguucagccuccccacguucgacucccugaacaucaccgccgccagccugaacgacgacggccucgacaaccacaccauccugcuguacuacuccaccgcggccagcucccuggccgucacgcucaugaucgccaucuucaucguguacauggugagccgcgacaacgucuccugcagcaucugccuguga

SEQ ID NO: 89581 - RNA, 1755 nt, Artificial Sequence
  derived and/or modified sequence opt1 from hemagglutinin__InfluenzaB__EPI271545
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccucaacgacgacgggcuggacaaccacaccauccugcuguacuacuccaccgccgcgagcucccucgccgugacccugaugcuggccaucuucaucgucuacauggugagccgggacaacguguccugcagcaucugccucuga

SEQ ID NO: 89582 - RNA, 1755 nt, Artificial Sequence
  derived and/or modified sequence opt1 from hemagglutinin__InfluenzaB__AGB08329
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaacauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagauccagaugaagucccuguacggcgacagcaacccccagaaguucaccuccagcgccaacggggugacgacccacuacgugucccagaucggcgacuuccccgaccagaccgaggacggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcagccucccccugaucggggaggcggacugccugcacgagaaguacggcgggcucaacaaguccaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacaccaucuccagccagaucgagcuggcgguccugcucuccaacgagggcaucaucaacagcgaggacgagcaccuccuggcccuggagcggaagcugaagaagaugcugggccccuccgccguggacaucgggaacggcugcuucgagacgaagcacaagugcaaccagaccugccucgaccgcaucgccgcggggaccuucaacgccggcgaguucagccugcccaccuucgacucccugaacaucaccgccgccagccucaacgacgacgggcuggacaaccacacgauccugcuguacuacuccaccgccgcgagcucccucgccgugacccugaugcuggccaucuucaucgucuacauggugagccgggacaacguguccugcagcaucugccucuga

SEQ ID NO: 89583 - RNA, 1755 nt, Artificial Sequence; identical to SEQ ID NO: 87763
  derived and/or modified sequence opt1 from hemagglutinin__InfluenzaB__EPI294880

SEQ ID NO: 89584 - RNA, 1752 nt, Artificial Sequence; identical to SEQ ID NO: 87474
  derived and/or modified sequence opt1 from hemagglutinin__InfluenzaB__CY018765

SEQ ID NO: 89585 - RNA, 1401 nt, Artificial Sequence
  derived and/or modified sequence opt1 from neuraminidase_glycoprotein__InfluenzaB__AAN39743
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcauccacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggaucaucaaggagaucuucccgacggggcgcguggagcacaccgaggagugcacgugcggcuucgcguccaacaagaccaucgagugcgugugccgggacaacagcuacaccgccaagcgccccuucgucaagcucaacguggagaccgacaccgccgagauccggcugaugugcaccgagacguaccuggacacgccccgccccgacgacggguccaucaccggcccgugcgagagcaacggggacaagggcaacggcgggaucaagggcggguucgugcaccagcggauggccucccgcaucggccggugguacagccgcaccauguccaagaccaagcggauggggauggagcucuacgucaaguacgacggcgaccccuggaccgacagcgacgcccuggcgcccuccggcgugauggugagcauggaggagcccgggugguacuccuucggcuucgagaucaaggacaagaagugcgacgucccgugcaucgggaucgagauggugcacgacggcgggaagaagaccuggcacagcgccgccaccgccaucuacugccugaugggcuccggccagcuccugugggacacggugaccggggucgacauggcccuguga

SEQ ID NO: 89586 - RNA, 1401 nt, Artificial Sequence
  derived and/or modified sequence opt1 from neuraminidase_glycoprotein__InfluenzaB__AAN39747
augcugcccagcaccauccagacccucauccuguuccugacguccggcggggugcuccugagccuguacgucuccgcccuccugagcuaccugcucuacuccgacauccugcugaaguucagcccgaccaagaucaucgcccccaccaugucccucgacugcgcgaacgccagcaacgugcaggccgugaaccacuccgccaccaaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgucaaccugggcaagauccccaccguggagaacuccaucuuccacauggccgccuggagcggguccgccugccacgacggccgcgaguggaccuacaucgggguggacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcgggucgagcacacggaggagugcacgugcggcuucgcguccaacaagaccaucgagugcgccugccgcgacaacagcuacaccgccaagcggcccuucgugaagcucaacguggagaccgacaccgccgagauccgccugaugugcaccaagaccuaccuggacacgccccggcccgacgacggguccaucaccggcccgugcgagagcaacggggacaagggcuccggcgggaucaagggcggguucguccaccagcgcauggccagcaagaucggccggugguacucccgcaccaugagcaagaccaagcggauggggauggagcucuacgugaaguacgacggcgaccccuggacggacuccgacgcgcuggcccccagcggcgugauggucuccaucgaggagcccgggugguacagcuucggcuucgagaucaaggacaagaagugcgacgugccgugcaucgggaucgagauggugcacgacggcgggaagaagaccuggcacuccgccgccaccgccaucuacugccugaugggcagcggccagcuccugugggacaccgucacggggguggacauggcgcuguga

SEQ ID NO: 89587 - RNA, 1401 nt, Artificial Sequence
  derived and/or modified sequence opt1 from neuraminidase_glycoprotein__InfluenzaB__AAN39749
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggaucaucaaggagaucuucccgacggggcgcguggagcacaccgaggagugcacgugcggcuucgcguccaacaagaccaucgagugcgccugccgggacaacagcuacaccgccaagcgccccuucgugaagcucaacgucgagaccgacaccgccgagauccggcugaugugcaccgagacguaccuggacacgccccgccccgacgacggguccaucaccggcccgugcgagagcaacggggacaagggcaacggcgggaucaagggcggguucgugcaccagcggauggccucccgcaucggccggugguacagccgcaccauguccaagaccaagcggauggggauggagcucuacgugaaguacgacggcgaccccuggaccgacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccugaugggcuccggccagcuccugugggacacggugaccgggguggacauggcgcuguga

SEQ ID NO: 89588 - RNA, 1401 nt, Artificial Sequence
  derived and/or modified sequence opt1 from neuraminidase_glycoprotein__InfluenzaB__AAN39751
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggauccucaaggagaucuucccgacggggcgcguggagcacaccgaggagugcacgugcggcuucgcguccaacaagaccaucgagugcgccugccgggacaacagcuacaccgccaagcgccccuucgugcagcugaacgucgagaccgacaccgccgagauccggcugaugugcaccgagacguaccucgacacgccccgccccgacgacggguccaucaccggcccgugcgagagcaacggggacaagggcaacggcgggaucaagggcggguucgugcaccagcggauggccucccgcaucggccggugguacagccgcaccauguccaagaccaagcggauggggauggaccuguacgugaaguacgacggcgaccccuggaccgacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccucaugggcuccggccagcugcugugggacacggugaccgggguggacauggcgcucuga

SEQ ID NO: 89589 - RNA, 1401 nt, Artificial Sequence
  derived and/or modified sequence opt1 from neuraminidase_glycoprotein__InfluenzaB__AAN39753
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcgaguacuacaacggcacccgggaggaccgcaacaagcugcggcaccucaucagcgugaaccuggggaagauccccaccguggagaacuccaucuuccacauggccgccuggagcggcuccgccugccacgacgggcgcgaguggaccuacaucggcgucgacgggcccgacagcaacgcgcugaucaagaucaaguacggcgaggccuacacggacaccuaccacuccuacgccaacaacauccuccggacccaggagagcgccugcaacugcaucggcggggacugcuaccugaugaucaccgacggcagcgccuccgggaucagccgcugccgguuccugaagauccgcgagggccggaucaucaaggagaucuucccgacgggccgcguggagcacaccgaggagugcacgugcggguucgcguccaacaagaccaucgagugcgccugccgggacaacagcuacaccgccaagcgccccuucgugaagcucaacgucgagaccgacaccgccgagauccggcugaugugcaccgagacguaccuggacacgccccgccccgacgacggcuccaucaccgggccgugcgagagcaacggcgacaaggggaacggcggcaucaagggcggguucgugcaccagcggauggccucccgcaucgggcggugguacagccgcaccauguccaagaccaagcggaugggcauggagcucuacgugaaguacgacggggaccccuggaccgacagcgacgcgcuggcccccuccggcgucauggugagcauggaggagcccggcugguacuccuucggguucgagaucaaggacaagaagugcgacgugccgugcaucggcaucgagaugguccacgacgggggcaagaagaccuggcacagcgccgccaccgccaucuacugccugaugggguccggccagcuccugugggacacggugaccggcguggacauggcgcuguga

SEQ ID NO: 89590 - RNA, 1401 nt, Artificial Sequence
  derived and/or modified sequence opt1 from neuraminidase_glycoprotein__InfluenzaB__AAN39759
augcugcccagcaccauccagacccucacgcuguuccugaccuccggcggggugcuccugagccuguacgucuccgccagccucuccuaccugcuguacagcgacauccuccugaagcuguccccgaccgagaucaccgcccccacgaugccccucgacugcgcgaacgccagcaacgugcaggccgugaaccgcuccgccaccaagggcgucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcgaggaccggaacaagcuccgccaccugaucagcgugaagcuggggaagaucccgacgguggagaacuccaucuuccacauggccgccuggagcggcuccgccugccacgacgggaaggaguggaccuacaucggcgucgacggccccgacagcaacgcccuccugaagaucaaguacggggaggcguacaccgacaccuaccacuccuacgccaacaacauccugcggacgcaggagagcgccugcaacugcaucggcgggaacugcuaccucaugaucaccgacggcagcgccuccggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccucaugugcaccgagaccuaccuggacaccccgcggcccgacgacggcuccaucacggggcccugcgagagcaacggcgacaagggcuccgggggcaucaagggcggguucgugcaccagcgcauggagagcaagaucgggcggugguacucccgcaccaugagcaagaccaagcggaugggcaugggccuguacgugaaguacgacggggaccccuggaccgacuccgacgcccucgcccugagcggcgucaugguguccaucgaggagccggggugguacagcuucggcuucgagaucaaggacaagaagugcgacgugcccugcaucgggaucgagaugguccacgacggcggcaaggagacguggcacuccgcggccaccgccaucuacugccugauggggagcggccagcuccugugggacaccgugaccgggguggacauggcccuguga

SEQ ID NO: 89591 - RNA, 1401 nt, Artificial Sequence
  derived and/or modified sequence opt1 from neuraminidase_glycoprotein__InfluenzaB__AAN39761
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcaucaagcacaccgaggagugcacgugcggguucgccuccaacaagaccaucgagugcgcgugccgggacaacagcuacaccgccaagcgccccuucgugaagcugaacguggagaccgacacggccgagauccggcugaugugcaccgagaccuaccucgacacgccccgcccggacgacggcuccaucaccgggcccugcgagagcaacggcgacaagggcuccgggggcaucaagggcggguucguccaccagcggauggccagcaagaucgggcgcugguacucccggaccaugagcaagaccaagcgcaugggcaugggccuguacgugaaguacgacggggaccccuggaccgacuccgaggcccuggcgcucagcggcgugauggucuccauggaggagcccgggugguacagcuucggcuucgagaucaaggacaagaagugcgacgugccgugcaucgggaucgagauggugcacgacggcggcaagacgaccuggcacuccgccgccaccgccaucuacugccugauggggagcggccagcugcucugggacaccgucacggggguggacauggcccuguga

SEQ ID NO: 89592 - RNA, 1401 nt, Artificial Sequence
  derived and/or modified sequence opt1 from neuraminidase_glycoprotein__InfluenzaB__AAN39769
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucaucaaggagaucuucccgaccgggcggguggagcacaccgaggagugcacgugcggcuucgcgagcaacaagaccaucgagugcgccugccgcgacaacuccuacaccgccaagcggcccuucgucaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucgugcaccagcgcauggccuccaagaucggccggugguacagccgcaccauguccaagaccaagcggauggggauggagcucuacgucaaguacgacggcgaccccuggaccgacagcgacgcgcuggcccccuccggcgugauggugagcaucgaggagcccgggugguacuccuucggcuucgagaucaaggacaagaagugcgacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 89593 - RNA, 1401 nt, Artificial Sequence
  derived and/or modified sequence opt1 from neuraminidase_glycoprotein__InfluenzaB__AAN39771
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucgugaaggagaucuucccgaccgggcgggucgagcacaccgaggagugcacgugcggcuucgcgagcaacaagaccaucgagugcgccugccgcgacaacuccuacaccgccaagcggcccuucgugaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucguccaccagcgcauggccuccaagaucggccggugguacagccgcaccauguccaagaccaagcggauggggauggagcucuacgugaaguacgacggcgaccccuggaccgacagcgacgcgcuggaccccuccggcgugauggucagcaucgaggagcccgggugguacuccuucggcuucgagaucaaggacaagaagugcgacgugccgugcaucgggaucgagauggugcacgacggcgggaagaccacguggcacagcgccgccaccgccaucuacugccugaugggcuccggccagcuccugugggacaccaucaccggggucgacauggcccuguga

SEQ ID NO: 89594 - RNA, 1401 nt, Artificial Sequence
  derived and/or modified sequence opt1 from neuraminidase_glycoprotein__InfluenzaB__AAN39773
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaacuucggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccugcggacccaggagagcgccugcaacugcaucgggggcgacugcuaccucaugaucacggacggguccgccagcggcaucuccaagugccgcuuccugaagauccgggagggccgcaucgugaaggagaucuucccgaccgggcgggucgagcacaccgaggagugcacgugcggcuucgcgagcaacaagaccaucgagugcgccugccgcgacaacuccuacaccgccaagcggcccuucgugaagcugaacguggagaccgacaccgccgagauccgccucaugugcacggagaccuaccuggacacgccccggcccgacgacgggagcaucaccggcccgugcgaguccaacggggacaagggcagcggcgggaucaagggcggguucguccaccagcgcauggccuccaagaucggccggugguacagccgcaccauguccaagaccaagcggauggggauggagcuguacgugaaguacgacggcgaccccuggaccgacagcgacgcgcucgcccccuccggcgugauggucagcaucgaggagcccgggugguacuccuucggcuucgagaucaaggacaagaagugcgacgugccgugcaucgggaucgagauggugcacgacggcgggaagaccacguggcacagcgccgccaccgccaucuacugccugaugggcuccggccagcugcucugggacaccaucaccggggucgacauggcgcuguga

SEQ ID NO: 89595 - RNA, 1401 nt, Artificial Sequence
  derived and/or modified sequence opt1 from neuraminidase_glycoprotein__InfluenzaB__AAN39775
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggcaaggaguggacguacaucgggguggacggccccgacuccaacgcgcugaucaagaucaaguacggcgaggccuacaccgacaccuaccacagcuacgccaacaacauccuccgcacccaggagagcgccugcaacugcaucgggggcgacugcuaccugaugaucacggacggguccgccagcggcaucuccaagugccgguuccugaagauccgcgagggccggaucaucaaggagaucuucccgaccgggcgcguggagcacaccgaggagugcacgugcggcuucgcgagcaacaagaccaucgagugcgccugccgggacaacuccuacaccgccaagcgccccuucgucaagcucaacguggagaccgacaccgccgagauccggcugaugugcacggagaccuaccuggacacgccccgccccgacgacgggagcaucaccggcccgugcgaguccaacggggacaagggcagcggcgggaucaagggcggguucgugcaccagcggauggccuccaagaucggccgcugguacagccggaccauguccaagaccaagcgcauggggauggagcucuacgucaaguacgacggcgaccccuggaccgacagcgacgcgcuggcccccuccggcgugauggugagcaucgaggagcccgggugguacuccuucggcuucgagaucaaggacaagaagugcgacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 89596 - RNA, 1401 nt, Artificial Sequence
  derived and/or modified sequence opt1 from neuraminidase_glycoprotein__InfluenzaB__AAN39777
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugccgcccgagcccgaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcgaggaccggaacaagcugcgccaccugaucagcgugaagcucgggaagaucccgacgguggagaacuccaucuuccacauggccgccuggagcggcuccgccugccacgacgggcgggaguggaccuacaucggcgucgacggccccgacagcaacgcccugcugaagaucaaguacggggaggcguacaccgacaccuaccacuccuacgccaagaacauccuccgcacgcaggagagcgccugcaacugcaucggcggggacugcuaccugaugaucaccgacggcagcgccuccggcaucagcgagugccgguuccugaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcucaacgucgagaccgacacggccgagauccggcugaugugcaccgagaccuaccuggacaccccgcgccccgacgacggcuccaucacggggcccugcgagagcaacggcaacaagggcuccgggggcaucaagggcggguucgugcaccagcggauggccagcaagaucgggcgcugguacucccggaccaugagcaagaccaagcgcaugggcaugggccucuacgugaaguacgacggggaccccuggaccgacuccgaggcccuggcgcugagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccucauggggagcggccagcugcugugggacaccgugacggggguggacauggcccucuga

SEQ ID NO: 89597 - RNA, 1401 nt, Artificial Sequence; identical to SEQ ID NO: 89592
  derived and/or modified sequence opt1 from neuraminidase_glycoprotein__InfluenzaB__AAN39779

SEQ ID NO: 89598 - RNA, 1401 nt, Artificial Sequence
  derived and/or modified sequence opt1 from neuraminidase_glycoprotein__InfluenzaB__AAN39781
augcugcccagcaccauccagacccucacgcuguuccugaccuccggcggggugcuccugagccuguacgucuccgccagccucuccuaccugcuguacagcgacauccuccugaaguucuccagcaccgagaucaccgccccgacgaugccccugaacugcgcgaacgccuccaacgugcaggccgugaaccacagcgccaccaagggcgucacccucccccugcccgagccggaguggaccuacccccgccuguccugccccgggagcacguuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucuccgugaagcucgggaagaucccgacgguggagaacagcaucuuccacauggccgccugguccggcagcgccugccacgacgggcgcgaguggaccuacaucggcgucgacggccccgacuccaacgcccugcugaagaucaaguacggggaggcguacaccgacaccuaccacagcuacgccaacaacauccuccggacgcaggagagcgccugcaacugcaucggcggggacugcuaccugaugaucaccgacggcuccgccagcggcguguccgagugccgcuuccugaagauccgggaggggcgcaucaucaaggagaucuuccccaccggccggguggagcacaccgaggagugcacgugcggguucgccagcaacaagaccaucgagugcgcgugccgcgacaacuccuacaccgccaagcggcccuucgucaagcucaacguggagaccgacacggccgagauccgccugaugugcaccgagaccuaccuggacaccccgcggcccgacgacggcagcaucacggggcccugcgaguccaacggcgacaagggcagcgggggcaucaagggcggguucgugcaccagcgcauggccuccaagaucgggcggugguacagccgcaccauguccaagaacaagcggaugggcaugggccucuacgucaaguacgacggggaccccuggaucgacagcgacgcccugacccuguccggcgugauggugagcauggaggagccggggugguacuccuucggcuucgagaucaaggacaagaagugcgacguccccugcaucgggaucgagauggugcacgacggcggcaaggagaccuggcacagcgcggccacggccaucuacugccucaugggguccggccagcugcugugggacaccgugaccggggucaacauggcccucuga

SEQ ID NO: 89599 - RNA, 1401 nt, Artificial Sequence
  derived and/or modified sequence opt1 from neuraminidase_glycoprotein__InfluenzaB__AAN39783
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccgaacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgaggcccuggcgcucagcggcgucaugguguccauggaggagcccgggugguacagcuucggcuucgagaucaaggacaagaagugcgacgugccgugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 89600 - RNA, 1401 nt, Artificial Sequence
  derived and/or modified sequence opt1 from neuraminidase_glycoprotein__InfluenzaB__AAN39785
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacuacgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggaucaucaaggagaucuucccgacggggcgcguggagcacaccgaggagugcacgugcggcuucgcguccaacaagaccaucgagugcgccugccgggacaacagcuacaccgccaagcgccccuucgugaagcucaacgucgagaccgacaccgccgagauccggcugaugugcaccgagacguaccuggacacgccccgccccgacgacggguccaucaccggcccgugcgagagcaacggggacaagggcuccggcgggaucaagggcggguucgugcaccagcggaugaccagccgcaucggccggugguacucccgcaccaugagcaagaccaagcggauggggauggagcucuacgugaaguacgacggcgaccccuggaccgacuccgacgcccuggcgcccagcggcgucaugguguccauggaggagcccgggugguacagcuucggcuucgagaucaaggacaagaagugcgacgugccgugcaucgggaucgagaugguccacgacggcgggaagaagaccuggcacuccgccgccacggccaucuacugccugaugggcagcggccagcuccugugggacaccgugaccgggguggacauggcccuguga

SEQ ID NO: 89601 - RNA, 1401 nt, Artificial Sequence
  derived and/or modified sequence opt1 from neuraminidase_glycoprotein__InfluenzaB__AAN39787
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacuacgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggaucaucaaggagaucuucccgacggggcgcguggagcacaccgaggagugcacgugcggcuucgcguccaacaagaccaucgagugcgccugccgggacaacagcuacaccgccaagcgccccuucgugaagcucaacgucgagaccgacaccgccgagauccggcugaugugcaccgagacguaccuggacacgccccgccccgacgacggguccaucaccggcccgugcgagagcaacggggacaagggcaacggcgggaucaagggcggguucgugcaccagcggauggccucccgcaucggccggugguacagccgcaccauguccaagaccaagcggauggggauggagcucuacgugaaguacgacggcgaccccuggaccgacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccugaugggcuccggccagcuccugugggacacggugaccgggguggacauggcgcuguga

SEQ ID NO: 89602 - RNA, 1401 nt, Artificial Sequence
  derived and/or modified sequence opt1 from neuraminidase_glycoprotein__InfluenzaB__AAN39795
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagacccgggggaacuccgcgccgcucaucauccgcgagcccuucaucgccugcggccccaaggagugcaagcacuucgcccugacccacuacgccgcgcagcccggcggguacuacaacggcacccgggaggaccgcaacaagcugcggcaccucaucagcgugaagcuggggaagaucccgacgguggagaacuccaucuuccacauggccgccuggagcggcuccgccugccacgacgggcgcgaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcggggacugcuaccugaugaucaccgacggcagcgccuccggcaccagcaagugccgcuuccucaagauccgggaggggcgcaucaucaaggagaucuuccccaccggccggguggagcacacggaggagugcacgugcggguucgccuccaacaagaccaucgagugcgcgugccgcgacaacaacuacaccgccaagcggcccuucgugaagcugaacgucgagaccgacgccgccgagauccgccugaugugcaccgagaccuaccucgacaccccgcggcccgacgacggcagcaucacggggcccugcgaguccaacggcgacaagggccgcgggggcaucaagggcggguucgugcaccagcggauggccagcaagaucgggcgcugguacucccggaccaugagcaagaccgagcgcaugggcauggagcuguacgugaaguacgacggcgaccccuggaccgacuccgacgcgcuggcccucagcggggucaugguguccauggaggagccgggcugguacagcuucggguucgagaucaaggacaagaagugcgacgugcccugcaucggcaucgagaugguccacgacgggggcaagaagacguggcacuccgccgccaccgccaucuacugccugaugggcagcgggcagcugcucugggacaccgugaccggcguggacauggcgcuguga

SEQ ID NO: 89603 - RNA, 1401 nt, Artificial Sequence; identical to SEQ ID NO: 89587
  derived and/or modified sequence opt1 from neuraminidase_glycoprotein__InfluenzaB__AAN39797

SEQ ID NO: 89604 - RNA, 1401 nt, Artificial Sequence
  derived and/or modified sequence opt1 from neuraminidase_glycoprotein__InfluenzaB__AAN39799
augcugcccagcaccauccagacccucacgcuguuccugaccuccggcggggugcuccugagccuguacgucuccgcccuccugagcuaccugcucuacuccgacgugcugcugaaguucagcccgaccaagaucaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucgaguacggcgaggccuacacggacaccuaccacuccuacgccuacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgacggggcggguggagcacaccgaggagugcacgugcggcuucgcguccaacaagaccaucgagugcgccugccgcgacaacagcuacaccgccaagcggcccuucgugaagcucaacgucgagaccgacaccgccgagauccgccugaugugcaccgagacguaccuggacacgccccggcccgacgacggguccaucaccggcccgugcgagagcaacggggacaagggcuccggcgggaucaagggcggguucgugcaccagcgcauggccagcaagaucggccggugguacucccgcaccaugagcaagaccaagcggauggggauggagcucuacgugaaguacgacggcgaccccuggaccgacuccgacgcgcuggcccccagcggcgucaugguguccauggaggagcccgggugguacagcuucggcuucgagaucaaggacaagaagugcgacgugccgugcaucgggaucgagaugguccacgacggcgggaagaagaccuggcacuccgccgccaccgccaucuacugccugaugggcagcggccagcuccugugggacacggugaccgggguggacauggcgcuguga

SEQ ID NO: 89605 - RNA, 1401 nt, Artificial Sequence
  derived and/or modified sequence opt1 from neuraminidase_glycoprotein__InfluenzaB__AAN39801
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgcccaggccgugaaccgcuccgccaccaagggcgugacccuccugcugcccgagccggaguggaccuacccccggcucagcugccccggguccacguuccagaaggcgcugcugaucagcccccaccgcuucggcgagaccaaggggaacuccgccccgcucaucauccgggagcccuucaucgccugcggccccaaggagugcaagcacuucgcccugacccacuacgcggcccagcccggcggguacuacaacggcacccgcgaggaccggaacaagcugcgccaccucaucagcgucaagcuggggaagaucccgacgguggagaacuccaucuuccacauggccgccuggagcggcuccgccugccacgacgggaaggaguggaccuacaucggcguggacggccccgacagcaacgcgcugcucaagaucaaguacggggaggccuacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggucaagcacaccgaggagugcacgugcggguucgcguccaacaagaccaucgagugcgccugccgcgacaacagcuacaccgccaagcggcccuucgugaagcugaacguggagaccgacacggccgagauccgccugaugugcaccgagaccuaccucgacaccccgcggcccgacgacggcuccaucacggggcccugcgagagcaacggcgacaagggcuccgggggcaucaagggcggguucguccaccagcgcauggccagcaagaucgggcggugguacucccgcaccaugagcaagaccaagcggaugggcaugggccuguacgugaaguacgacggggaccccuggaccgacuccgacgcgcuggcccucagcggcgugauggucuccauggaggagccggggugguacagcuucggcuucgagaucaaggacaagaagugcgacgugcccugcaucgggaucgagauggugcacgacggcggcaaggagacguggcacuccgccgccaccgccaucuacugccugauggggagcggccagcugcucugggacaccgucaccgggguggacauggcgcuguga

SEQ ID NO: 89606 - RNA, 1401 nt, Artificial Sequence
  derived and/or modified sequence opt1 from neuraminidase_glycoprotein__InfluenzaB__AAN39803
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccaaggugccccuggacugcgcgaacgccagcaacgugcaggccgucaaccgcuccgccacgaagggcaugacccuccugcugagcgagcccgaguggaccuacccgcggcucuccugccaggggagcaccuuccagaaggcccugcugaucagcccccaccgcuucggcgagacgcgggggaacuccgcgccccucaucauccgcgagcccuucaucgccugcggcccgaaggagugcaagcacuucgcccugacccacuacgccgcgcagcccggcggguacuacaacggcacccgggaggaccgcaacaagcugcggcaccucaucuccgugaagcuggggaagauccccaccguggagaacagcaucuuccacauggccgccugguccggcagcgccugccacgacgggcgcgaguggacguacaucggccuggacggccccgacuccaacgcccucaucaagaucaaguacggggaggcguacaccgacaccuaccacagcuacgccaacaacauccugcggacccaggagagcgccugcaacugcaucggcggggacugcuaccugaugaucacggacggcuccgccagcggcaucuccaagugccgcuuccucaagauccgggaggggcgcaucaucaaggagaucuucccgaccggccgggucgagcacaccgaggagugcacgugcggguucgccagcaacaagaccaucgagugcgcgugccgcgacaacuccuacaccgccaagcggcccuucgugaagcugaacguggagaccgacaccgccgagauccgccugaugugcacggagaccuaccucgacacgccccggcccgacgacggcagcaucaccgggccgugcgaguccaacggcgacaagggccgcgggggcaucaagggcggguucguccaccagcggauggccagcaagaucgggcgcugguacucccggaccaugagcaagaccgagcgcaugggcauggagcuguacgugaaguacgacggcgaccccuggaccgacuccgacgcccuggcgcccagcggggugauggucuccaugaaggagcccggcugguacagcuucggguucgagaucaaggacaagaagugcgacgugccgugcaucggcaucgagauggugcacgacgggggcaaggagaccuggcacuccgccgccacggccaucuacugccucaugggcagcgggcagcugcugugggacaccgucaccggcguggacauggcccucuga

SEQ ID NO: 89607 - RNA, 1401 nt, Artificial Sequence
  derived and/or modified sequence opt1 from neuraminidase__InfluenzaB__ABA02232
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgagaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 89608 - RNA, 1401 nt, Artificial Sequence
  derived and/or modified sequence opt1 from neuraminidase__InfluenzaB__ABI84039
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaaguacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89609 - RNA, 1401 nt, Artificial Sequence
  derived and/or modified sequence opt1 from neuraminidase__InfluenzaB__ABI84051
augcugcccagcaccauccagacccucacgcuguuccugaccuccggcggggugcuccugagccuguacgucuccgccagccucuccuaccugcuguacagcgacauccuccugcgcuucucccagaccgagaucaccgccccgaucaugccccuggacugcgcgaacgccagcaacgugcaggccgugaaccacuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 89610 - RNA, 1401 nt, Artificial Sequence
  derived and/or modified sequence opt1 from neuraminidase__InfluenzaB__ABI84062
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaucaugccccuggacugcgcgaacgccagcaacgugcaggccgugaaccgcuccaccacgaagggcgucacccuccugcugcccgagccggaguggaccuacccccggcucagcugccccggguccaccuuccagaaggcccugcugaucagcccccaccgcuucggcgagacgaaggggaacuccgccccgcucaucauccgggagcccuucaucgcgugcggccccaaggagugcaagcacuucgcccugacccacuacgccgcccagcccggcggguacuacaacggcacccgcggggaccggaacaagcugcgccaccucaucagcgugaagcugggcaagaucccgaccguggagaacuccaucuuccacauggcggccuggagcggguccgccugccacgacggcaaggaguggacguacaucggcgucgacgggcccgacaacaacgcccugcucaagaucaaguacggcgaggccuacaccgacaccuaccacagcuacgcgaacaacauccugcggacccaggaguccgccugcaacugcaucgggggcaacugcuaccugaugaucacggacggccccgccagcgggaucagcgagugccgcuuccucaagauccgggagggccgcaucaucaaggagaucuuccccaccgggcgggugaagcacaccgaggagugcacgugcggcuucgccuccaacaagaccaucgagugcgccugccgcgacaacagcuacaccgcgaagcggccguucgugaagcugaacgucgagaccgacaccgccgagauccgccugaugugcacggagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgugaaguacgacggcgacccgugggccgacuccgacgcccuggcgcucagcggggucaugguguccauggaggagcccggcugguacagcuucggguucgagaucaaggacaagaagugcgacgugcccugcaucggcaucgagaugguccacgacggcgggaaggagaccuggcacuccgccgccaccgccaucuacugccugaugggcagcgggcagcugcucugggacacggugaccggcguggacauggcccuguga

SEQ ID NO: 89611 - RNA, 1401 nt, Artificial Sequence
  derived and/or modified sequence opt1 from neuraminidase__InfluenzaB__ABL76280
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaucgacuccgacgcccugacccucagcggcgucaugguguccauggaggagccggggugguacagcuucggcuucgagaucaaggacaagaagugcgacgugcccugcaucgggaucgagaugguccacgacggcggcaagaagacguggcacuccgcggccaccgccaucuacugccugauggggagcggccagcugcucugggacaccgugaccgggguggacauggcccuguga

SEQ ID NO: 89612 - RNA, 1401 nt, Artificial Sequence
  derived and/or modified sequence opt1 from neuraminidase__InfluenzaB__ABL76302
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcgaggaccggaacaagcugcgccaccucaucuccgugaagcuggggaagauccccacgguggagaacagcaucuuccacauggccgccugguccggcagcgccugccacgacgggcgggaguggaccuacaucggcgucgacggccccgacuccaacgcccugcucaagaucaaguacggggaggcguacaccgacaccuaccacagcuacgccaacaacauccugcgcacgcaggaguccgccugcaacugcaucggcgggaacugcuaccugaugaucaccgacggcagcgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgcccguucgugaagcugaacgucgagaccgacacggccgagauccggcugaugugcaccgagaccuaccucgacacgccccgccccgacgacggcagcaucaccgggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggacccguggaccgacagcgacccccuggcccucuccggcgucauggugagcauggaggagcccgggugguacuccuucggcuucgagaucaaggacaagaagugcgacgugcccugcaucgggaucgagaugguccacgacggcggcaaggagacguggcacagcgcggccaccgccaucuacugccugaugggguccggccagaugcugugggacaccgugaccgggguggacauggcccucuga

SEQ ID NO: 89613 - RNA, 1401 nt, Artificial Sequence
  derived and/or modified sequence opt1 from neuraminidase__InfluenzaB__ABL76313
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccugaacugcgcgaacgccagcaacgugcaggccgugaaccgcuccgccacgaagggcgucaccuucccccucccggagcccgaguggaccuacccccggcugagcugccccggguccaccuuccagaaggcccugcucaucagcccgcaccgcuucggcgagacgaaggggaacuccgcgccccugaucauccgggagcccuucaucgccugcggccccaaggagugcaagcacuucgcccugacccacuacgccgcgcagccgggcggguacuacaacggcacccgcgaggaccggaacaagcuccgccaccugaucagcgugaagcuggggaagauccccaccguggagaacuccaucuuccacauggccgccuggagcggcuccgccugccacgacgggcgggaguggacguacaucggcgucgacggccccgacagcaacgcccuccugaagaucaaguacggggaggcguacaccgacaccuaccacuccuacgccaacaacauccugcgcacccaggagagcgccugcaacugcaucggcggggacugcuaccucaugaucacggacggcagcgccuccggcaucagcgagugccgguuccugaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgcccguucgugaagcugaacgucgagaccgacaccgccgagauccggcucaugugcacggagaccuaccuggacacgccccgccccgacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggacccguggaucgacuccgacgcccucacccugagcggcgucaugguguccguggaggagcccgggugguacagcuucggcuucgagaucaaggacaagaagugcgacguccccugcaucgggaucgagauggugcacgacggcggcaagaccacguggcacuccgcggccaccgccaucuacugccugauggggagcggccagcuccugugggacaccgugaccggggucgacauggcccuguga

SEQ ID NO: 89614 - RNA, 1401 nt, Artificial Sequence
  derived and/or modified sequence opt1 from neuraminidase__InfluenzaB__ABL76335
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccucccccugccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaaggagugcaagcacuucgcccucacccacuacgccgcgcagccgggcggguacuacaacggcacccgcgaggaccggaacaagcugcgccaccugaucagcgugaagcucgggaagauccccacgguggagaacuccaucuuccacauggccgccuggagcggcuccgccugccacgacgggcgggaguggaccuacaucggcgucgacggccccgacagcaacgcccugcugaagaucaaguacggggaggcguacaccgacaccuaccacuccuacgccaacaacauccuccgcacgcaggagagcgccugcaacugcaucggcggggacugcuaccugaugaucaccgacggcagcgccuccggcaucagcgagugccgguuccugaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgcccguucgugaagcucaacgucgagaccgacacggccgagauccggcugaugugcaccgagaccuaccuggacacgccccgccccgacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccucuacgugaaguacgacggggacccguggaucgacuccgacgcccugacccugagcggcgucaugguguccauggaggagcccgggugguacagcuucggcuucgagaucaaggacaagaagugcgacgugcccugcaucgggaucgagaugguccacgacggcggcaagacgaccuggcacuccgcggccaccgccaucuacugccucauggggagcggccagcugcugugggacaccgugacggggguggacauggcccucuga

SEQ ID NO: 89615 - RNA, 1401 nt, Artificial Sequence
  derived and/or modified sequence opt1 from neuraminidase__InfluenzaB__ABL76346
augcugcccagcaccauccagacccucacgcuguuccugaccuccggcggggugcuccugagccuguacgucuccgccagccucuccuaccugcuguacagcgacauccuccugaaguucuccccgaaggagaucaccacccccacgaugccccugaacugcgccaacgcgagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacccgcgaggaccggaacaagcugcgccaccucaucagcgugaagcuggggaagaucccgacgguggagaacuccaucuuccacauggcggccuggagcggcuccgccugccacgacgggcgggaguggaccuacaucggcgucgacggccccgacagcaacgcccugcucaagaucaaguacggggaggccuacaccgacaccuaccacuccuacgcgaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgccugccgggacaacagcuacaccgcgaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaucgacuccgacgcccugacccucagcggcgucaugguguccauggaggagccggggugguacagcuucggcuucgagaucaaggacaagaagugcgacgugcccugcaucgggaucgagaugguccacgacggcggcaagacgaccuggcacuccgccgcgaccgccaucuacugccugauggggagcggccagcugcucugggacaccgugacggggguggacauggcccuguga

SEQ ID NO: 89616 - RNA, 1401 nt, Artificial Sequence; identical to SEQ ID NO: 89615
  derived and/or modified sequence opt1 from neuraminidase__InfluenzaB__ABL76357

SEQ ID NO: 89617 - RNA, 1401 nt, Artificial Sequence
  derived and/or modified sequence opt1 from neuraminidase__InfluenzaB__ABL76368
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccggcgcccuggcgcucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcugcucugggacaccgugaccggcguggacauggcccuguga

SEQ ID NO: 89618 - RNA, 1404 nt, Artificial Sequence
  derived and/or modified sequence opt1 from neuraminidase__InfluenzaB__ABL76379
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaccgacuccgacgcccuggcgcucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcugcucugggacaccgugaccggcguggacauggcccuguga

SEQ ID NO: 89619 - RNA, 1401 nt, Artificial Sequence
  derived and/or modified sequence opt1 from neuraminidase__InfluenzaB__ABL76390
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccagcaccaagggcgucaccuuccuccugcccgagccggaguggaccuacccccggcuguccugccccgggagcacguuccagaaggcccuccugaucagcccccaccgcuucggcgagaccaaggggaacuccgccccgcugaucauccgggagcccuucaucgcgugcggccccaaggagugcaagcacuucgcccucacccacuacgccgcccagcccggcggguacuacaacggcacccgcgaggaccggaacaagcugcgccaccugaucuccgugaagcucgggaagaucccgacgguggagaacagcaucuuccacauggcggccugguccggcagcgccugccacgacgggaaggaguggaccuacaucggcgucgacggccccgacuccaacgcccugcugaagaucaaguacggggaggccuacaccgacaccuaccacagcuacgcgaacaacauccuccggacgcaggagagcgccugcaacugcaucggcgggaacugcuaccugaugaucaccgacggcuccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggcccuucgugaagcucaacgucgagaccgacacggccgagauccgccugaugugcaccgagaccuaccuggacaccccgcggcccgacgacggcagcaucacgggguccugcgagagcgacggcgacaagggcuccgggggcaucaagggcggguucgugcaccagcgcauggccagcaagaucgggcggugguacucccgcaccaugagcaagaccaagcggaugggcaugggccucuacgugcgcuacgacggggaccccuggaccgacuccagcgcccuggcccuguccggcgucauggugagcauggaggagcccgggugguacuccuucggcuucgagaucaaggacaagaagugcgacgugccgugcaucgggaucgagaugguccacgacggcggcaaggagacguggcacagcgcggccaccgccaucuacugccucaugggguccggccagcugcugugggacaccgugaccgggguggacauggcccucuga

SEQ ID NO: 89620 - RNA, 1401 nt, Artificial Sequence
  derived and/or modified sequence opt1 from neuraminidase__InfluenzaB__ABL76412
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugauccccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacaccgcccagcccggcggguacuacaacggcacgcgcggggaccggaacaagcugcgccaccugaucagcgugaagcucggcaagaucccgaccguggagaacuccaucuuccacauggcggccuggagcggguccgccugccacgacggcaaggaguggaccuacaucggcgucgacgggcccgacagcaacgcccugcugaagaucaaguacggcgaggccuacaccgacacguaccacuccuacgcgaacaacauccuccggacccaggagagcgccugcaacugcaucgggggcaacugcuaccugaugaucaccgacggcagcgccuccgggaucagcgagugccgcuuccugaagauccgggagggccgcaucaucaaggagaucuuccccaccgggcgggugaagcacacggaggagugcacgugcggcuucgccuccaacaagaccaucgagugcgccugccgcgacaacagcuacaccgcgaagcggcccuucgugaagcucaacgucgagaccgacaccgccgagauccgccugaugugcaccgagaccuaccuggacacgccgcggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcucuacgugaaguacgacggcgaccccuggacggacuccgacgcccuggcccugagcggggucaugguguccauggaggagccgggcugguacagcuucggguucgagaucaaggacaagaagugcgacgugcccugcaucggcaucgagaugguccacgacggcgggaaggagaccuggcacuccgcggccaccgccaucuacugccucaugggcagcgggcagcugcugugggacaccgugacgggcguggacauggcccucuga

SEQ ID NO: 89621 - RNA, 1401 nt, Artificial Sequence
  derived and/or modified sequence opt1 from neuraminidase__InfluenzaB__ABL76423
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcgcacgcaggagagcgccugcaacugcaucgggggcaacugcuaccugaugaucaccgacggcagcgccuccgggaucagcgagugccgguuccucaagauccgcgagggccggaucaucaaggagaucuuccccaccgggcgcgugaagcacaccgaggagugcacgugcggcuucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggguccaucacgggccccugcgagagcaacggcgacaagggguccggcgggaucaagggcggguucgugcaccagcggauggccagcaagaucggccgcugguacucccggaccaugagcaagaccaagcgcaugggcauggggcuguacgugaaguacgacggcgaccccuggaccgacuccgacgcccuggcguucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccucaugggcagcgggcagcugcugugggacaccgugaccggcguggacauggcccucuga

SEQ ID NO: 89622 - RNA, 1401 nt, Artificial Sequence
  derived and/or modified sequence opt1 from neuraminidase__InfluenzaB__ABL76434
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagauccgcgacaagaagugcgacgugcccugcaucggcaucgagaugguccacgacggcgggaaggagaccuggcacagcgccgccacggccaucuacugccugaugggcuccgggcagcugcucugggacaccgugaccggcguggacauggcgcuguga

SEQ ID NO: 89623 - RNA, 1401 nt, Artificial Sequence
  derived and/or modified sequence opt1 from neuraminidase__InfluenzaB__ABL76456
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaagcuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 89624 - RNA, 1401 nt, Artificial Sequence
  derived and/or modified sequence opt1 from neuraminidase__InfluenzaB__ABL76467
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcugcucugggacaccgugaccggcguggacauggcgcuguga

SEQ ID NO: 89625 - RNA, 1401 nt, Artificial Sequence
  derived and/or modified sequence opt1 from neuraminidase__InfluenzaB__ABL76478
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaagcuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacgaagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 89626 - RNA, 1401 nt, Artificial Sequence
  derived and/or modified sequence opt1 from neuraminidase__InfluenzaB__ABL76522
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 89627 - RNA, 1401 nt, Artificial Sequence
  derived and/or modified sequence opt1 from neuraminidase__InfluenzaB__ABL76533
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 89628 - RNA, 1401 nt, Artificial Sequence
  derived and/or modified sequence opt1 from neuraminidase__InfluenzaB__ABL76544
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggagcggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 89629 - RNA, 1401 nt, Artificial Sequence; identical to SEQ ID NO: 89627
  derived and/or modified sequence opt1 from neuraminidase__InfluenzaB__ABL76566

SEQ ID NO: 89630 - RNA, 1401 nt, Artificial Sequence
  derived and/or modified sequence opt1 from neuraminidase__InfluenzaB__ABL76588
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacuacgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 89631 - RNA, 1401 nt, Artificial Sequence; identical to SEQ ID NO: 89626
  derived and/or modified sequence opt1 from neuraminidase__InfluenzaB__ABL76599

SEQ ID NO: 89632 - RNA, 1401 nt, Artificial Sequence; identical to SEQ ID NO: 89626
  derived and/or modified sequence opt1 from neuraminidase__InfluenzaB__ABL76610

SEQ ID NO: 89633 - RNA, 1401 nt, Artificial Sequence
  derived and/or modified sequence opt1 from neuraminidase__InfluenzaB__ABL76621
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgagaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacauccccugcaucggcaucgagaugguccacgacggcgggaaggagaccuggcacagcgccgccacggccaucuacugccugaugggcuccgggcagcugcucugggacaccgugaccggcguggacauggcgcuguga

SEQ ID NO: 89634 - RNA, 1401 nt, Artificial Sequence
  derived and/or modified sequence opt1 from neuraminidase__InfluenzaB__ABL76632
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagaugcgccaccugaucagcgugaagcucgggaagauccccacgguggagaacuccaucuuccacauggccgccuggagcggcuccgccugccacgacgggaaggaguggaccuacaucggcgucgacggcccggacagcaacgcccugcugaagaucaaguacggggaggcguacaccgacaccuaccacuccuacgccaagaacauccuccggacgcaggagagcgccugcaacugcaucggcggggacugcuaccugaugaucaccgacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccucuacgugaaguacgacggggaccccuggaccgacagcgaggcccuggcgcuguccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccguguacugccucaugggguccggccagcugcugugggacaccgugacgggggucgacauggcccucuga

SEQ ID NO: 89635 - RNA, 1401 nt, Artificial Sequence
  derived and/or modified sequence opt1 from neuraminidase__InfluenzaB__ABL76643
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 89636 - RNA, 1401 nt, Artificial Sequence
  derived and/or modified sequence opt1 from neuraminidase__InfluenzaB__ABL76654
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccacgaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaccgagugcaagcacuucgcccugacccacuacgccgcccagcccggcggguacuacaacggcacgcgcgaggaccggaacaagcugcgccaccucaucagcgugaagcuggggaagauccccaccguggagaacuccaucuuccacauggcggccuggagcggcuccgccugccacgacgggaaggaguggaccuacaucggcgucgacggcccggacagcaacgcccugcucaagaucaaguacggggaggccuacaccgacacguaccacuccuacgcgaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacacggaggagugcacgugcggguucgccagcaacaagaccaucgagugcgccugccgcgacaacuccuacaccgcgaagcggcccuucgugaagcugaacgucgagaccgacaccgccgagauccgccugaugugcaccgagaccuaccucgacacgccgcggcccaacgacggcagcaucaccgggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggacggacagcgaggcccuggcccucuccggcgucauggugagcauggaggagccggggugguacuccuucggcuucgagaucaaggacaagaagugcgacgugcccugcaucgggaucgagaugguccacgacggcggcaagaccaccuggcacagcgcggccaccgccaucuacugccugaugggguccggccagcugcucugggacacggugaccgggguggacauggcccuguga

SEQ ID NO: 89637 - RNA, 1401 nt, Artificial Sequence
  derived and/or modified sequence opt1 from neuraminidase__InfluenzaB__ABL76665
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguucgacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 89638 - RNA, 1401 nt, Artificial Sequence
  derived and/or modified sequence opt1 from neuraminidase__InfluenzaB__ABL76676
augcugcccagcaccauccagacccucacgcuguuccugaccuccggcggggugcuccugagccuguacgucuccgccagccucuccuaccugcuguacagcgacauccuccugaaguucucccagaccggcaucaccgccccgaucaugccccuggacugcgcgaacgccagcaacgugcaggccgugaaccgcuccgccacgaagggggucacccuccugcugcccgagcccgaguggaccuacccgcggcucagcugccccggcuccaccuuccagaaggcccugcugaucagcccccaccgcuucggggagacgaagggcaacuccgcgccccucaucauccgggagccguucaucgccugcggccccaaggagugcaagcacuucgcccugacccacuacgccgcgcagcccgggggcuacuacaacgggacccgcgaggaccggaacaagcugcgccaccucaucagcgugaagcugggcaagauccccaccguggagaacuccaucuuccacauggccgccuggagcggguccgccugccacgacggccgggaguggacguacaucggcgucgacgggccggacagcaacgcccugcucaagaucaaguacggcgaggcguacaccgacaccuaccacuccuacgccaagaacauccugcgcacccaggagagcgccugcaacugcaucgggggcgacugcuaccugaugaucacggacggccccgccagcgggaucuccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacgggagcaucaccggccccugcgaguccaacggcgacaaggggagcggcgggaucaagggcggguucgugcaccagcggauggccuccaagaucggccgcugguacagccggacgauguccaagaccaagcgcaugggcauggggcuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcguggacauggcccuguga

SEQ ID NO: 89639 - RNA, 1401 nt, Artificial Sequence
  derived and/or modified sequence opt1 from neuraminidase__InfluenzaB__ABL76687
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguucgacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcccuggcgcucagcggcgucauggugccgauggaggagcccgggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 89640 - RNA, 1401 nt, Artificial Sequence
  derived and/or modified sequence opt1 from neuraminidase__InfluenzaB__ABL76698
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagacccgggggaacuccgcgccgcucaccauccgcgagcccuucaucgccugcggccccaaggagugcaagcacuucgcccugacccacuacgccgcgcagcccggcggguacuacaacggcacgcgggaggaccgcaacaagcugcggcaccucaucagcgucaagcuggggaagaucccgaccguggagaacuccaucuuccacauggccgccuggagcggcuccgccugccacgacgggcgcgaguggaccuacaucggcguggacggccccgacagcaacgcccugaucaagaucaaguacggggaggcguacaccgacacguaccacuccuacgccaacaacauccuccggacccaggagagcgccugcaacugcaucggcggggacugcuaccugaugaucaccgacggcagcgccuccggcaucagcaagugccgcuuccugaagauccgggaggggcgcaucaucaaggagaucuuccccaccggccgggucgagcacacggaggagugcacgugcggguucgccuccaacaagaccaucgagugcgcgugccgcgacaacagcuacaccgccaagcggcccuucgugaagcucaacguggagaccgacaccgccgagauccgccugaugugcaccgagaccuaccuggacacgccgcggcccgacgacggcuccaucaccgggcccugcgagagcaacggcgacaagggccgcgggggcaucaagggcggguucguccaccagcggauggccuccaagaucgggcgcugguacagccggaccauguccaagaccgagcgcaugggcauggagcucuacgugaaguacgacggcgaccccuggacggacagcgaggcccuggcgccguccggggugauggucagcauggaggagcccggcugguacuccuucggguucgagaucaaggacaagaagugcgacgugcccugcaucggcaucgagauggugcacgacgggggcaagaagaccuggcacagcgccgccaccgccaucuacugccugaugggcuccgggcagcuccugugggacaccgucacgggcguggacauggcccuguga

SEQ ID NO: 89641 - RNA, 1401 nt, Artificial Sequence
  derived and/or modified sequence opt1 from neuraminidase__InfluenzaB__ABL76720
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcgcagcgccgccacggccaucuacugccucaugggcuccgggcagcugcugugggacaccgugaccggcgucgacauggcgcucuga

SEQ ID NO: 89642 - RNA, 1401 nt, Artificial Sequence
  derived and/or modified sequence opt1 from neuraminidase__InfluenzaB__ABL76731
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgccaucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacacggccgagauccgccugaugugcaccgacaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcucuacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcgcuguga

SEQ ID NO: 89643 - RNA, 1401 nt, Artificial Sequence
  derived and/or modified sequence opt1 from neuraminidase__InfluenzaB__ABL76742
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89644 - RNA, 1401 nt, Artificial Sequence
  derived and/or modified sequence opt1 from neuraminidase__InfluenzaB__ABL76753
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaccgggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacaacaacgcccugcucaagaucaaguacggggaggcguacaccgacaccuaccacagcuacgccaagaacauccugcgcacgcaggaguccgccugcaacugcaucggcggggacugcuaccugaugaucaccgacggccccgccagcggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccaacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 89645 - RNA, 1401 nt, Artificial Sequence; identical to SEQ ID NO: 89614
  derived and/or modified sequence opt1 from neuraminidase__InfluenzaB__ABL76764

SEQ ID NO: 89646 - RNA, 1401 nt, Artificial Sequence; identical to SEQ ID NO: 89614
  derived and/or modified sequence opt1 from neuraminidase__InfluenzaB__ABL76775

SEQ ID NO: 89647 - RNA, 1401 nt, Artificial Sequence
  derived and/or modified sequence opt1 from neuraminidase__InfluenzaB__ABL76797
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaaggagacguggcacuccgccgccaccgccaucuacugccugauggggagcggccagcugcucugggacaccgugaccggggugaacauggcccuguga

SEQ ID NO: 89648 - RNA, 1401 nt, Artificial Sequence
  derived and/or modified sequence opt1 from neuraminidase__InfluenzaB__ABL76819
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaaggagacguggcacuccgccgccaccgccaucuacugccugauggggagcggccagcugcucugggacaccgugaccgggguggacauggcccuguga

SEQ ID NO: 89649 - RNA, 1401 nt, Artificial Sequence
  derived and/or modified sequence opt1 from neuraminidase__InfluenzaB__ABL76830
augcugcccagcaccauccagacccucacgcuguuccugaccuccggcggggugcuccugagccuguacgucuccgccagccucuccuaccugcuguacagcgacauccuccugaaguucuccccgaccaagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccaagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 89650 - RNA, 1401 nt, Artificial Sequence
  derived and/or modified sequence opt1 from neuraminidase__InfluenzaB__ABL76852
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggagagcaagaucgggcggugguacucccgcaccaugagcaagaccaagcggaugggcaugggccuguacgugaaguacgacggggaccccuggaccgacuccgacgcccuggcccucagcggcgucaugguguccaucgaggagccggggugguacagcuucggcuucgagaucaaggacaagaagugcgacgugcccugcaucgggaucgagaugguccacgacggcggcaaggagacguggcacuccgcggccaccgccaucuacugccugauggggagcggccagcugcucugggacaccgugaccgggguggacauggcccuguga

SEQ ID NO: 89651 - RNA, 1401 nt, Artificial Sequence
  derived and/or modified sequence opt1 from neuraminidase__InfluenzaB__ABL76863
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaaggagacguggcacuccgccgccaccgccaucuacugccugauggggagcggccagcugcucugggacaccgugaccgggguggacauggccauguga

SEQ ID NO: 89652 - RNA, 1401 nt, Artificial Sequence
  derived and/or modified sequence opt1 from neuraminidase__InfluenzaB__ABL76874
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaacuccagcgccaccaagggcgucacccuccugcugcccgagccggaguggaccuacccccgccucuccugccccgggagcacguuccagaaggcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacccgcggggaccggaacaagcugcggcaccucaucuccgugaagcugggcaagaucccgacgguggagaacagcaucuuccacauggccgccugguccgggagcgccugccacgacggcaaggaguggaccuacaucggcgucgacgggcccgacuccaacgcccugcucaagaucaaguacggcgaggcguacaccgacaccuaccacagcuacgccaacaacauccugcgcacgcaggagagcgccugcaacugcaucgggggcaacugcuaccugaugaucaccgacggcuccgccagcgggaucuccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgugaagcugaacgucgagaccgacacggccgagaucaagcugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 89653 - RNA, 1401 nt, Artificial Sequence
  derived and/or modified sequence opt1 from neuraminidase__InfluenzaB__ABL76885
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacuacgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccggacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgaggcccuggcgcucagcggcgucaugguguccauggaggagcccgggugguacagcuucggcuucgagaucaaggacaagaagugcgacgugccgugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 89654 - RNA, 1401 nt, Artificial Sequence
  derived and/or modified sequence opt1 from neuraminidase__InfluenzaB__ABL76896
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggauguacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacaccgccgagauccggcugaugugcacggagaccuaccucgacacgccccgcccggacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgaggcccuggcgcucagcggcgucaugguguccauggaggagcccgggugguacagcuucggcuucgagaucaaggacaagaagugcgacgugccgugcaucgggaucgagaugguccacgacggcggcaagaccacguggcacuccgccgccaccgccaucuacugccugauggggagcggccagcugcucugggacgccgugaccgggguggacauggcgcuguga

SEQ ID NO: 89655 - RNA, 1401 nt, Artificial Sequence
  derived and/or modified sequence opt1 from neuraminidase__InfluenzaB__ABL76918
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucaucggggugaugguguccauggaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcugcucugggacaccgugaccggcgucaacauggcgcuguga

SEQ ID NO: 89656 - RNA, 1401 nt, Artificial Sequence
  derived and/or modified sequence opt1 from neuraminidase__InfluenzaB__ABL76962
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccaugucccucgacugcgcgaacgccagcaacgugcaggccgugaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgucaaccugggcaagauccccaccguggagaacuccaucuuccacauggccgccuggagcggguccgccugccacgacggccgcgaguggaccuacaucgggguggacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgacggggcgggucgagcacaccgaggagugcacgugcggcuucgcguccaacaagaccaucgagugcgccugccgcgacaacagcuacaccgccaagcggcccuucgugaagcucaacguggagaccgacaccgccgagauccgccugaugugcaccgagacguaccuggacacgccccggcccgacgacggguccaucaccggcccgugcgagagcaacggggacaagggcuccggcgggaucaagggcggguucguccaccagcgcauggccagcaagaucggccggugguacucccgcaccaugagcaagaccaagcggauggggauggagcucuacgugaaguacgacggcgaccccuggaccgacuccgacgcgcuggcccccagcggcgugauggucuccauggaggagcccgggugguacagcuucggcuucgagaucaaggacaagaagugcgacgugccgugcaucgggaucgagauggugcacgacggcgggaagaagaccuggcacuccgccgccaccgccaucuacugccugaugggcagcggccagcuccugugggacacggucaccgggguggacauggcgcuguga

SEQ ID NO: 89657 - RNA, 1401 nt, Artificial Sequence; identical to SEQ ID NO: 89587
  derived and/or modified sequence opt1 from neuraminidase__InfluenzaB__ABL76973

SEQ ID NO: 89658 - RNA, 1401 nt, Artificial Sequence
  derived and/or modified sequence opt1 from neuraminidase__InfluenzaB__ABL76984
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccucuccgccaccaagggcgucacccugcugcuccccgagcccgaguggaccuacccgcgccugagcugccccggguccacguuccagaaggcccugcucaucagcccccaccgguucggcgagaccaaggggaacuccgcgccccugaucauccgcgagccguucaucgccugcggccccaaggagugcaagcacuucgcccugacccacuacgccgcgcagcccggcggguacuacaacggcacccgggaggaccgcaacaagcuccggcaccugaucagcgugaagcuggggaagauccccacgguggagaacuccaucuuccacauggccgccuggagcggcuccgccugccacgacgggcgcgaguggaccuacaucggcgucgacggcccggacagcaacgcccuccugaagaucaaguacggggaggcguacaccgacaccuaccacuccuacgccaacaacauccugcggacgcaggagagcgccugcaacugcaucggcgggaacugcuaccucaugaucaccgacggcagcgccuccggcaucagcgagugccgcuuccugaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacacggccgagauccgccucaugugcaccgagaccuaccuggacacgccccggccggacgacggcuccaucaccgggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccucgcgcugagcggcgucaugguguccauggaggagcccgggugguacagcuucggcuucgagaucaaggacaagaagugcgacgugccgugcaucgggaucgagaugguccacgacggcggcaagcgcacguggcacuccgccgccaccgccaucuacugccugauggggagcggccagcuccugugggacaccgugaccgggguggacauggcccuguga

SEQ ID NO: 89659 - RNA, 1401 nt, Artificial Sequence; identical to SEQ ID NO: 89614
  derived and/or modified sequence opt1 from neuraminidase__InfluenzaB__ABL77006

SEQ ID NO: 89660 - RNA, 1401 nt, Artificial Sequence; identical to SEQ ID NO: 89658
  derived and/or modified sequence opt1 from neuraminidase__InfluenzaB__ABL77017

SEQ ID NO: 89661 - RNA, 1401 nt, Artificial Sequence
  derived and/or modified sequence opt1 from neuraminidase__InfluenzaB__ABL77028
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaaggagacguggcacuccgccgccaccgccaucuacugccugauggggagcggccagcugcucugggacaccgugaccgggguggacauggcccuguga

SEQ ID NO: 89662 - RNA, 1401 nt, Artificial Sequence
  derived and/or modified sequence opt1 from neuraminidase__InfluenzaB__ABL77039
augcugcccagcaccauccagacccucacgcuguuccugaccuccggcggggugcuccugagccuguacgucuccgccagccucuccuaccugcuguacagcgacauccuccugaaguucuccccgaccgagaccacggcccccaccaugccccuggacugcgcgaacgccagcaacgugcaggccgugaacugcuccgccaccaagggcgucacccuccugcugcccgagccggaguggacguacccccgccucagcugccccggguccaccuuccagaaggcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacgcgggaggaccgcaacaagcugcggcaccucaucagcgugaagcuggggaagaucccgaccguggagaacuccaucuuccacauggccgccuggagcggcuccgccugccacgacgggaaggaguggaccuacaucggcgucgacggccccgacagcaacgcccugcucaagaucaaguacggggaggcguacaccgacacguaccacuccuacgccaacaacauccugcgcacccaggagagcgccugcaacugcaucggcgggaacugcuaccugaugaucaccgacggcagcgccuccggcaucagcgagugccgguuccucaagauccgcgaggggcggaucaucaaggagaucuuccccaccggccgcguggagcacacggaggagugcacgugcggguucgccuccaacaagaccaucgagugcgcgugccgggacaacagcuacaccgccaagcgccccuucgugaagcugaacgucgagaccgacaccgccgagauccggcugaugugcaccgagaccuaccucgacacgccgcgccccgacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggacggacuccgacgcccuggcgcucagcggcgucaugguguccauggaggagccggggugguacagcuucggcuucgagaucaaggacaagaagugcgacgugcccugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 89663 - RNA, 1401 nt, Artificial Sequence
  derived and/or modified sequence opt1 from neuraminidase__InfluenzaB__ABL77050
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaaggagugcaagcacuucgcccugacccacuacgcggcccagcccggcggguacuacaacggcacccgcgaggaccggaacaagcugcgccaccucaucagcgugaagcuggggaagaucccgaccguggagaacuccaucuuccacauggccgccuggagcggcuccgccugccacgacgggaaggaguggacguacaucggcgucgacggccccgacagcaacgcgcugcucaagaucaaguacggggaggccuacaccgacaccuaccacuccuacgccaacaacauccugcggacccaggagagcgccugcaacugcaucggcgggaacugcuaccugaugaucacggacggcagcgccuccggcaucagcgagugccgcuuccucaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacaccgccgagauccgccugaugugcacggagaccuaccucgacaccccgcggcccgacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgacgcgcuggcccucagcggcgucaugguguccauggaggagccggggugguacagcuucggcuucgagaucaaggacaagaagugcgacgugcccugcaucgggaucgagaugguccacgacggcggcaaggagaccuggcacuccgccgccacggccaucuacugccugauggggagcggccagcugcucugggacaccgugaccgggguggacauggcgcuguga

SEQ ID NO: 89664 - RNA, 1401 nt, Artificial Sequence
  derived and/or modified sequence opt1 from neuraminidase__InfluenzaB__ABL77072
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucaucaaggagaucuucccgaccgggcggguggagcacaccgaggagugcacgugcggcuucgcgagcaacaagaccaucgagugcgccugccgcgacaacuccuacaccgccaagcggcccuucgucaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucgugcaccagcgcauggccuccaagaucggccggugguacagccgcaccauguccaagaccaagcggauggggauggagcucuacgucaaguacgacggcgaccccuggaccgacagcgacgcgcuggcccccuccggcgugauggugagcaucaaggaguccgggugguacagcuucggcuucgagaucaaggacaagaagugcgacguccccugcaucgggaucgagauggugcacgacggcgggaagaccacguggcacuccgccgccaccgccaucuacugccugaugggcagcggccagcuccugugggacaccgugaccggggucgacauggcgcuguga

SEQ ID NO: 89665 - RNA, 1401 nt, Artificial Sequence; identical to SEQ ID NO: 89592
  derived and/or modified sequence opt1 from neuraminidase__InfluenzaB__ABL77083

SEQ ID NO: 89666 - RNA, 1401 nt, Artificial Sequence; identical to SEQ ID NO: 89592
  derived and/or modified sequence opt1 from neuraminidase__InfluenzaB__ABL77094

SEQ ID NO: 89667 - RNA, 1401 nt, Artificial Sequence
  derived and/or modified sequence opt1 from neuraminidase__InfluenzaB__ABL77105
augcugcccagcaccauccagacccucacgcuguuccugaccuccggcggggugcuccugagccuguacgucuccgccagccucuccuaccugcuguacagcgacauccuccugaaguucuccagcaccgagaucaccgccccgacgaugccccuggacugcgcgaacgccuccaacgugcaggccgugaaccgcagcgccaccgagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucuccgugaagcuggggaagauccccacgguggagaacagcaucuuccacauggccgccugguccggcagcgccugccacgacgggaaggaguggaccuacaucggcgucgacggcccggacuccaacgcccugcucaagaucaaguacggggaggcguacaccgacaccuaccacagcuacgccaacaacauccugcggacgcaggagagcgccugcaacugcaucggcgggaacugcuaccugaugaucaccgacggcuccgccagcggcaucuccgagugccgcuuccucaagauccgggaggggcgcaucaucaaggagaucuuccccaccggccggguggagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacacgccccggccggacgacggcagcaucaccgggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgacgcccuggcgcucuccggcgucauggugagcauggaggagcccgggugguacuccuucggcuucgagaucaaggacaagaagugcgacgugccgugcaucgggaucgagaugguccacgacggcggcaaggagacguggcacagcgccgccaccgccaucuacugccugaugggguccggccagcugcucugggacaccgugaccgggguggacauggcccuguga

SEQ ID NO: 89668 - RNA, 1401 nt, Artificial Sequence; identical to SEQ ID NO: 89592
  derived and/or modified sequence opt1 from neuraminidase__InfluenzaB__ABL77127

SEQ ID NO: 89669 - RNA, 1401 nt, Artificial Sequence
  derived and/or modified sequence opt1 from neuraminidase__InfluenzaB__ABL77138
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucaucaaggagaucuucccgaccgggcggguggagcacaccgaggagugcacgugcggcuucgcgagcaacaagaccaucgagugcgccugccgcgacaacuccuacaccgccaagcggcccuucgucaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucgugcaccagcgcauggccuccaagaucggccggugguacagccgcaccauguccaagaccaagcggauggggauggagcucuacgucaaguacgacggcgaccccuggaccgacagcgacgcgcuggcccccuccggcgugauggugagcaucgaggagcccgggugguacuccuucggcuucgagaucaaggacaagaagugcgacgucccgugcaucgggaucgagauggugcacgacggcgggaagaccacgugguacagcgccgccaccgccaucuacugccugaugggcuccggccagcuccugugggacaccgugaccggggucgacauggcgcuguga

SEQ ID NO: 89670 - RNA, 1401 nt, Artificial Sequence; identical to SEQ ID NO: 89592
  derived and/or modified sequence opt1 from neuraminidase__InfluenzaB__ABL77149

SEQ ID NO: 89671 - RNA, 1401 nt, Artificial Sequence
  derived and/or modified sequence opt1 from neuraminidase__InfluenzaB__ABL77160
augcugcccagcaccauccagacccucacgcuguuccugaccuccggcggggugcuccugagccuguacgucuccgccagccucuccuaccugcuguacagcgacauccuccugaaguucucccagaccaagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccgaacgacggcuccaucaccgggcccugcgagagcgacggcgaccggggcuccgggggcaucaagggcggguucgugcaccagcgcauggagagcaagaucgggcggugguacucccgcaccaugagcaagaccaagcggaugggcaugggccuguacgugaaguacgacggggaccccuggaccgacuccgaggcccuggcccucagcggcgucaugguguccauggaggagcccgggugguacagcuucggcuucgagaucaaggacaagaagugcgacgugccgugcaucgggaucgagaugguccacgacggcggcaagacgaccuggcacuccgcggccaccaccaucuacugccugauggggagcggccagcugcucugggacacggugaccgggguggacauggcccuguga

SEQ ID NO: 89672 - RNA, 1401 nt, Artificial Sequence; identical to SEQ ID NO: 89624
  derived and/or modified sequence opt1 from neuraminidase__InfluenzaB__ABL77171

SEQ ID NO: 89673 - RNA, 1401 nt, Artificial Sequence
  derived and/or modified sequence opt1 from neuraminidase__InfluenzaB__ABL77182
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucgugaaggagaucuucccgaccgggcgggucgagcacaccgaggagugcacgugcggcuucgcgagcaacaagaccaucgagugcgccugccgcgacaacuccuacaccgccaagcggcccuucgugaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucguccaccagcgcauggccuccaagaucggccggugguacagccgcaccauguccaagaccaagcggauggggauggagcucuacgugaaguacgacggcgaccccuggaccgacagcgacgcgcuggcccccuccggcgugauggucagcaucgaggagcccgggugguacuccuucggcuucgagaucaaggacaagaagugcgacgugccgugcaucgggaucgagauggugcacgacggcgggaagaccacguggcacagcgccgccaccgccaucuacugccugaugggcuccggccagcuccugugggacaccaucaccggggucgacauggcgcuguga

SEQ ID NO: 89674 - RNA, 1401 nt, Artificial Sequence; identical to SEQ ID NO: 89599
  derived and/or modified sequence opt1 from neuraminidase__InfluenzaB__ABL77193

SEQ ID NO: 89675 - RNA, 1401 nt, Artificial Sequence
  derived and/or modified sequence opt1 from neuraminidase__InfluenzaB__ABL77204
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugauccccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacagcgcccugcugaagaucaaguacggcgaggcguacaccgacaccuaccacuccuacgccaacaacauccuccggacgcaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcucaacguggagaccgacacggccgagauccgccugaugugcaccgagaccuaccuggacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcucuacgucaaguacgacggcgaccccugggccgacuccgacgcgcuggcccugagcggggugaugguguccauggaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 89676 - RNA, 1401 nt, Artificial Sequence
  derived and/or modified sequence opt1 from neuraminidase__InfluenzaB__ABL77215
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggccuucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcgugaacauggcgcucuga

SEQ ID NO: 89677 - RNA, 1401 nt, Artificial Sequence; identical to SEQ ID NO: 89635
  derived and/or modified sequence opt1 from neuraminidase__InfluenzaB__ABL77226

SEQ ID NO: 89678 - RNA, 1401 nt, Artificial Sequence
  derived and/or modified sequence opt1 from neuraminidase__InfluenzaB__ABL77237
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89679 - RNA, 1401 nt, Artificial Sequence
  derived and/or modified sequence opt1 from neuraminidase__InfluenzaB__ABL77248
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccaugucccucgacugcgcgaacgccagcaacgugcaggccgccaaccacuccgccacgaaggagaugaccuuccugcugcccgagcccgaguggaccuacccgcgccucagcugccagggcuccaccuuccagaaggcgcugcugaucagcccccaccgguucggggaggccaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccgucgagaacuccaucuuccacauggccgccuggagcggguccgcgugccacgacggccgcgaguggaccuacaucgggguggacggccccgacagcaacgcccugaucaagaucaaguacggcgaggccuacacggacaccuaccacuccuacgccaacaacauccuccggacccaggagagcgccugcaacugcaucgggggcgacugcuaccugaugaucaccgacgggagcgcguccggcaucagcaagugccgcuuccugaagauccgggagggccgcaucaucaaggagaucuucccgacggggcggguggagcacaccgaggagugcacgugcggcuucgccuccaacaagaccaucgagugcgccugccgcgacaacagcuacaccgccaagcggcccuucgucaagcucaacguggagaccgacaccgccgagauccgccugaugugcaccgagacguaccuggacacgccccggcccgacgacggguccaucaccggcccgugcgagagcaacggggagaagggccgcggcgggaucaagggcggguucgugcaccagcggauggcguccaagaucggccgcugguacagccggaccauguccaagaccgagcgcauggggauggagcucuacgucaaguacgacggcgaccccuggaccgacagcgacgcccuggcccccuccggcgugauggugagcaugaaggagcccgggugguacuccuucggcuucgagaucaaggacaagaagugcgacgucccgugcaucgggaucgagauggugcacgacggcgggaagaagaccuggcacagcgccgccaccgcgaucuacugccugaugggcuccggccagcuccugugggacacggugaccggggucgacauggcccuguga

SEQ ID NO: 89680 - RNA, 1401 nt, Artificial Sequence
  derived and/or modified sequence opt1 from neuraminidase__InfluenzaB__ABL77259
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccaaggugccccuggacugcgcgaacgccagcaacgugcaggccgucaaccgcuccgccacgaagggcaugacccuccugcugagcgagcccgaguggaccuacccgcggcucuccugccaggggagcaccuuccagaaggcccugcugaucagcccccaccgcuucggcgagacgcgggggaacuccgcgccccucaucauccgcgagcccuucaucgccugcggcccgaaggagugcaagcacuucgcccugacccacuacgccgcgcagcccggcggguacuacaacggcacccgggaggaccgcaacaagcugcggcaccucaucuccgugaagcuggggaagauccccaccguggagaacagcaucuuccacauggccgccugguccggcagcgccugccacgacgggcgcgaguggacguacaucggcgucgacggccccgacuccaacgcccugaucaagaucaaguacggggaggcguacaccgacaccuaccacagcuacgccaacaacauccuccggacccaggagagcgccugcaacugcaucggcggggacugcuaccugaugaucacggacggcuccgccagcggcaucuccaagugccgcuuccugaagauccgggaggggcgcaucaucaaggagaucuucccgaccggccggguggagcacaccgaggagugcacgugcggguucgccagcaacaagaccaucgagugcgcgugccgcgacaacuccuacaccgccaagcggcccuucgugaagcucaacgucgagaccgacaccgccgagauccgccugaugugcacggagaccuaccuggacacgccccggcccgacgacggcagcaucaccgggccgugcgaguccaacggcgacaagggccgcgggggcaucaagggcggguucgugcaccagcggauggccagcaagaucgggcgcugguacucccggaccaugagcaagaccgagcgcaugggcauggagcucuacgugaaguacgacggcgaccccuggaccgacuccgacgcccuggcgcccagcggggucaugguguccaugaaggagcccggcugguacagcuucggguucgagaucaaggacaagaagugcgacgugccgugcaucggcaucgagaugguccacgacgggggcaagaagaccuggcacuccgccgccacggccaucuacugccugaugggcagcgggcagcuccugugggacaccgugaccggcguggacauggcccuguga

SEQ ID NO: 89681 - RNA, 1401 nt, Artificial Sequence
  derived and/or modified sequence opt1 from neuraminidase__InfluenzaB__ABL77270
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagacccgggggaacuccgcgccgcucaucauccgcgagcccuucaucgccugcggccccaaggagugcaagcacuucgcccugacccacuacgccgcgcagcccggcggguacuacaacggcacccgggaggaccgcaacaagcugcggcaccucaucagcgucaagcuggggaagaucccgacgguggagaacuccaucuuccacauggccgccuggagcggcuccgccugccacgacgggcgcgaguggaccuacaucggcguggacggccccgacagcaacgcccugaucaagaucaaguacggggaggcguacaccgacaccuaccacuccuacgccaacaacauccuccggacgcaggagagcgccugcaacugcaucggcggggacugcuaccugaugaucaccgacggcagcgccuccggcaucagcaagugccgcuuccugaagauccgggaggggcgcaucaucaaggagaucuuccccaccggccgggucgagcacaccgaggagugcacgugcggguucgccuccaacaagaccaucgagugcgcgugccgcgacaacagcuacaccgccaagcggcccuucgugaagcucaacguggagaccgacacggccgagauccgccugaugugcaccgagaccuaccuggacaccccgcggcccgacgacggcuccaucacggggcccugcgagagcaacggcgacaagggccgcgggggcaucaagggcggguucguccaccagcggauggccuccaagaucgggcgcugguacagccggaccauguccaagaccgagcgcaugggcauggagcucuacgugaaguacgacggcgaccccuggaccgacagcgaggcccuggcgccguccggggugauggucagcauggaggagcccggcugguacuccuucggguucgagaucaaggacaagaagugcgacgugcccugcaucggcaucgagauggugcacgacgggggcaagaagacguggcacagcgccgccaccgccaucuacugccugaugggcuccgggcagcuccugugggacaccgucaccggcguggacauggcccuguga

SEQ ID NO: 89682 - RNA, 1401 nt, Artificial Sequence
  derived and/or modified sequence opt1 from neuraminidase__InfluenzaB__ABL77281
augcugcccagcaccauccagacccucacgcuguuccugaccuccggcggggugcuccugagccuguacgucuccgugagccucuccuaccugcuguacagcgacauccuccugcgcuucuccccgaccgagaucaccgcccccacgaugccccuggacugcgccaacgcgagcaacgugcaggccgucaaccgguccgccaccaagggcaugacccuccgccugcccgagccggaguggaccuacccccggcugagcugccccggguccacguuccagaaggcccuccugaucagcccccaccgcuucggcgagacccgggggaacuccgccccgcugaucauccgcgagcccuucaucgcgugcggccccaaggagugcaagcacuucgcccucacccacuacgccgcccagcccggcggguacuacaacggcacccgggaggaccgcaacaagcugcggcaccugaucagcgugaagcucgggaagaucccgacgguggagaacuccaucuuccacauggcggccuggagcggcuccgccugccacgacgggcgcgaguggaccuacaucggcgucgacggccccgacagcaacgcccugaucaagaucaaguacggggaggccuacaccgacaccuaccacuccuacgcgaacaacauccugcggacgcaggagagcgccugcaacugcaucggcggggacugcuaccucaugaucaccgacggcagcgccuccgagaucagcaagugccgcuuccugaagauccgggagggccgcaucaucaaggagaucuuccccaccgggcggguggagcacaccgaggagugcacgugcggcuucgccuccaacaagaccaucgagugcgccugccgcgacaacagcuacaccgcgaagcggcccuucgugaagcugaacgucgagaccgacacggccgagauccgccucaugugcaccgagaccuaccuggacaccccgcggcccgacgacggguccaucacgggccccugcgagagcaacggggacaagggccgcggcgggaucaagggcggguucgugcaccagcggauggccuccaagaucggccgcugguacagccgcaccauguccaagaccgagcggauggggauggagcuguacgugaaguacgacggcgaccccuggaccgacagcgaggcccucgccccguccggcgucauggugagcauggaggagcccgggugguacuccuucggcuucgagaucaaggacaagaagugcgacgugcccugcaucgggaucgagaugguccacgacggcgggaagaagacguggcacagcgcggccaccgccaucuacugccugaugggcuccggccagcugcucugggacaccgugaccgggguggacauggcccuguga

SEQ ID NO: 89683 - RNA, 1401 nt, Artificial Sequence
  derived and/or modified sequence opt1 from neuraminidase__InfluenzaB__ABL77292
augcugcccagcaccauccagacccucacgcuguuccugaccuccggcggggugcuccugagccuguacgucuccgccagccucuccuaccugcuguacagcggcgugcuccugaaguucuccccgaccgagaucaccgcccccacgaugccccuggacugcgcgaacgccagcaacgugcaggccgucaaccgcuccgccaccaagggggugacccuccugcugcccgagccggaguggaccuacccccggcucagcugccccggcuccacguuccagaaggcccugcugaucagcccccaccgcuucggggagacccggggcaacuccgcgccgcucaucauccgcgagcccuucaucgccugcggccccaaggagugcaagcacuucgcccugacccacuacgccgcgcagcccgggggcuacuacaacgggacccgggaggaccgcaacaagaugcggcaccugaucagcgugaagcucggcaagaucccgacggucgagaacuccaucuuccacauggccgccuggagcggguccgccugccacgacggccgcgaguggaccuacaucggcguggacgggcccgacagcaacgcccugaucaagaucaaguacggcgaggcguacaccgacaccuaccacuccuacgccaacaacauccugcggacgcaggagagcgccugcaacugcaucgggggcgacugcuaccucaugaucaccgacggcagcgccuccgggaucagcaagugccgcuuccugaagauccgggagggccgcaucaucaaggagaucuuccccaccgggcggguggagcacaccgaggagugcacgugcggcuucgccuccaacaagaccaucgagugcgcgugccgcgacaacagcuacaccgccaagcggcccuucgucaagcugaacguggagaccgacacggccgagauccgccucaugugcaccgagaccuaccuggacaccccgcggcccgacgacggguccaucacgggccccugcgagagcaacggcgacaaggggcugggcgggaucaagggcggguucgugcaccagcgcauggccuccaagaucggccggugguacagccgcaccauguccaagaccgagcggaugggcauggagcucuacgucaaguacgacggggaccccuggaccgacagcgacgcccuggcgcuguccggcgugauggugagcauggaggagccggggugguacuccuucggcuucgagaucaaggacaagaagugcgacguccccugcaucgggaucgagauggugcacgacggcggcaagaagacguggcacagcgccgccaccgccaucuacugccucaugggguccggccagcugcugugggacaccgugaccggggucgacauggcccucuga

SEQ ID NO: 89684 - RNA, 1398 nt, Artificial Sequence
  derived and/or modified sequence opt1 from neuraminidase__InfluenzaB__ABL77303
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaucucccucgacugcgcgaacgccagcaacgugcaggccgugaaccacuccgccaccaaggagaugacguuccugcugcccgagcccgaguggaccuacccgcgccucagcugccagggcuccaucuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucagcgucaaccugggcaagauccccacgguggagaacuccaucuuccacauggccgccuggagcggguccgccugccacgacggccgcgaguggaccuacaucgggguggacggccccgacagcaacgcgcugaucaagaucaaguacggcgaggccuacaccgacaccuaccacuccuacgccaacaacauccuccggacgcaggagagcgccugcaacugcaucgggggcgacugcuaccugaugaucaccgacgggagcgccuccggcaucagcaagugccgcuuccugaagauccgggagggccgcaucaucaaggagaucuucccgaccgggcgggucgagcacaccgaggagugcacgugcggcuucgcguccaacaagaccaucgagugcgccugccgcgacaacagcuacaccgccaagcggcccuucgugaagcucaacguggagaccgacacggccgagauccgccugaugugcaccgagaccuaccuggacacgccccggcccgacgacggguccaucaccggcccgugcgagagcaacggggacaagggccgcggcggggucaagggcggguucgugcaccagcggaucgccuccaagaucggccgcugguacagccggaccauguccaagaccgagcgcauggggauggagcucuacgugaaguacgacggcgaccccuggaccgacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagacguggcacagcgccgccaccgccaucuacugccugaugggcuccggccagcuccugugggacaccgugaccgggguggacauggcgcuguga

SEQ ID NO: 89685 - RNA, 1398 nt, Artificial Sequence
  derived and/or modified sequence opt1 from neuraminidase__InfluenzaB__ABL77314
augcugcccagcaccauccagacccucacgcuguuccugaccuccggcggggugcuccugagccuguacgucuccgcccuccugagcuaccugcucuacuccgacgugcugcugaaguucagcccgaagaucaucgcccccaccaugucccucgacugcgcgaacgccagcaacgugcaggccgucaaccacuccgccaccgaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcggguggagcacacggaggagugcacgugcggcuucgcguccaacaagaccaucgagugcgccugccgcgacaacagcuacaccgccaagcggcccuucgugaagcucaacgucgagaccgacaccgccgagauccgccugaugugcaccgagaccuaccuggacacgccccggcccgacgacggguccaucaccggcccgugcgagagcaacggggacaagggccacggcgggaucaagggcggguucgugcaccagcgcauggccuccaagaucggccggugguacagccgcaccauguccaagaccaagcggauggggauggagcucuacgugaaguacgacggcgaccccuggacggacagcgacgcgcuggcccccuccggcgucauggugagcauggaggagcccgggugguacuccuucggcuucgagauccgcgacaagaagugcgacgugccgugcaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 89686 - RNA, 1401 nt, Artificial Sequence
  derived and/or modified sequence opt1 from neuraminidase__InfluenzaB__ABL77325
augcugcccagcaccauccagacccucacgcuguuccugaccuccggcggggugcuccugagccuguacgucuccgcccuccugagcuacucccuguacagcgacauccuccugaaguucuccccgaccaagaccaucgcccccacgaugagccuggacugcgcgaacgccuccaacgugcaggccgugaaccacagcgccaccaagggcaugacccuccugcugcccgagcccgaguggaccuacccgcgccucuccugccaggggagcacguuccagaaggcccugcugaucagcccccaccgguucggcgagaccaaggggaacuccgcgccccucaucauccgcgagcccuucaucgccugcggcccgaaggagugcaagcacuucgcccugacccacuacgccgcgcagcccggcggguacuacaacggcacccgggaggaccgcaacaagcugcggcaccucaucuccgucagccuggggaagauccccacgguggagaacuccaucuuccacauggccgccuggagcggcuccgccugccacgacgggcgcgaguggaccuacaucggcguggacggccccgacagcaacgcccugaucaagaucaaguacggggaggcguacaccgacaccuaccacagcuacgccaacaacauccuccggacgcaggaguccgccugcaacugcaucggcggggacugcuaccugaugaucaccgacggcagcgccuccggcaucagcaagugccgcuuccugaagauccgggaggggcgcaucaucaaggagaucuucccgaccggccgggucgaccacaccgaggagugcacgugcggguucgccuccaacaagaccaucgagugcgcgugccgcgacaacagcuacaccgccaagcggcccuucgugaagcucaacguggagaccgacacggccgagauccgccugaugugcaccgagaccuaccuggacacgccccggcccgacgacggcuccaucaccgggccgugcgagagcaacggcgacaagggccgcgggggcaucaagggcggguucguccaccagcggauggccuccaagaucgggcgcugguacagccggaccauguccaagaccgagcgccucggcauggagcuguacgugaaguacgacggcgaccccuggaccgacagcgacgcccuggcgcccuccggggugauggucagcgccgaggagcccggcugguacuccuucggguucgagaucaaggacaagaagugcgacgugccgugcaucggcaucgagauggugcacgacgggggcaagaagacguggcacagcgccgccaccgccaucuacugccucaugggcuccgggcagcugcugugggacaccgucaccggcguggacauggcgcucuga

SEQ ID NO: 89687 - RNA, 1401 nt, Artificial Sequence
  derived and/or modified sequence opt1 from neuraminidase__InfluenzaB__ABL77336
augcugcccagcaccauccagacccucacgcuguuccugaccuccggcggggugcuccugagccuguacgucuccgccagccucuccuaccugcuguacagcgacauccuccugaaguucuccccgaccgagaucaccgccccgcccaugccccuggacugcgcgaacgccagcaacgugcaggccgugaaccgcuccgccacgaagggcgucacccuccugcugcccgagcccgaguggaccuacccccggcucagcugccccggguccaccuuccagaaggcccugcugaucagcccgcaccgcuucggcgagacgcgggggaacuccgcgccccucaucauccgcgagcccuucaucgccugcggccccaaggagugcaagcacuucgccaucacccacuacgccgcgcagccgggcggguacuacaacggcacccgggaggaccgcaacaagcugcggcaccugaucagcgugaagcucgggaagauccccaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaacaacauccuccggacccaggagagcgccugcaacugcaucggcggggacugcuaccugaugaucacggacggcagcgccuccggcaucagcaagugccgcuuccugaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggccguucgugaagcucaacgucgagaccgacaccgccgagauccgccugaugugcacggagaccuaccuggacacgccccggcccgacgacggcuccaucaccgggcccugcgagagcaacggcgacaagggccgcgggggcaucaagggcggguucgugcaccagcggauggccuccaagaucgggcgcugguacagccggaccauguccaagaccgaccgcaugggcauggagcucuacgugaaguacgacggcgacccguggaccgacagcgacgcccuggcgcuguccggggucauggugagcauggaggagcccggcugguacuccuucggguucgagaucaaggacaagaagugcgacgugcccugcaucggcaucgagaugguccacgacgggggcaagaagaccuggcacagcgccgccacgaccaucuacugccucaugggcuccgggcagcugcugugggacaccgugaccggcguggacauggcccucuga

SEQ ID NO: 89688 - RNA, 1401 nt, Artificial Sequence
  derived and/or modified sequence opt1 from neuraminidase__InfluenzaB__ABL77347
augcugcccagcaccauccagacccucacgcuguuccugaccuccggcggggugcuccugagccuguacgucuccgccagccucuccuaccugcuguacagcgacauccuccugaaguucuccccgaccaagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagacccgcgggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaagaagacguggcacuccgccgccaccgccaucuacugccugauggggagcggccagcugcucugggacaccgugaccgggguggacauggcccuguga

SEQ ID NO: 89689 - RNA, 1398 nt, Artificial Sequence
  derived and/or modified sequence opt1 from neuraminidase__InfluenzaB__ABL77380
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaccucccucgacugcgcgaacgccagcaacgugcaggccgugaaccacuccgccacgaaggagaugaaguuccugccgcccgagcccgaguggaccuacccccgccugagcugccagggcuccaccuuccagaaggcccuccugaucagcccccaccgguucggggaggcgaagggcaacuccgcgccccugaucauccgcgagccguucaucgccugcgggcccaaggagugcaagcacuucgcccucacccacuacgccgcccagcccggcggcuacuacaacgggacgcgggaggaccgcaacaagcugcggcaccugaucagcgucaaccucggcaagauccccaccguggagaacuccaucuuccacauggccgccuggagcggguccgccugccacgacggccgcgaguggaccuacaucgggguggacggcccggacagcaacgcgcugaucaagaucaaguacggcgaggccuacaccgacacguaccacuccuacgccaacaacauccugcggacccaggagagcgccugcaacugcaucgggggcgacugcuaccucaugaucaccgacgggagcgccuccggcaucagcaagugccgcuuccugaagauccgggagggccgcaucaucaaggagaucuuccccaccgggcgggucgagcacacggaggagugcacgugcggcuucgcguccaacaagaccaucgagugcgccugccgcgacaacagcuacaccgccaagcggcccuucgugaagcugaacguggagaccgacaccgccgagauccgccucaugugcaccgagaccuaccuggacacgccccggccggacgacggguccaucaccggccccugcgagagcaacggggacaagggcuccggcggggucaagggcggguucgugcaccagcgcauggccagcaagaucggccggugguacucccgcaccaugagcaagaccaagcggauggggauggagcuguacgugaaguacgacggcgaccccuggacggacuccgacgcgcucgcccccagcggcgucaugguguccauggaggagccggggugguacagcuucggcuucgagaucaaggacaagaagugcgacgugcccugcaucgggaucgagaugguccacgacggcgggaagcgcaccuggcacuccgccgccaccgccaucuacugccugaugggcagcggccagcugcucugggacaccgugacgggggugaacauggcgcuguga

SEQ ID NO: 89690 - RNA, 1401 nt, Artificial Sequence
  derived and/or modified sequence opt1 from neuraminidase__InfluenzaB__ABL77391
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 89691 - RNA, 1401 nt, Artificial Sequence
  derived and/or modified sequence opt1 from neuraminidase__InfluenzaB__ABL84344
augcugcccagcaccauccagacccucacgcuguuccugaccuccggcggggugcuccugagccuguacgucuccgccagccucuccuaccugcuguacagcgacauccuccugaaguucuccagcaccgagaucaccgccccgacgaugccccugaacugcgcgaacgccuccaacgugcaggccgugaaccacagcgccaccaagggcgucacccucccccugcccgagccggaguggaccuacccccgccuguccugccccgggagcacguuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucuccgugaagcucgggaagaucccgacgguggagaacagcaucuuccacauggccgccugguccggcagcgccugccacgacgggcgcgaguggaccuacaucggcgucgacggccccgacuccaacgcccugcugaagaucaaguacggggaggcguacaccgacaccuaccacagcuacgccaacaacauccuccggacgcaggagagcgccugcaacugcaucggcggggacugcuaccugaugaucaccgacggcuccgccagcggcguguccgagugccgcuuccugaagauccgggaggggcgcaucaucaaggagaucuuccccaccggccggguggagcacaccgaggagugcacgugcggguucgccagcaacaagaccaucgagugcgcgugccgcgacaacuccuacaccgccaagcggcccuucgucaagcucaacguggagaccgacacggccgagauccgccugaugugcaccgagaccuaccuggacaccccgcggcccgacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccucuacgucaaguacgacggggaccccuggaucgacagcgacgcccugacccuguccggcgugauggugagcauggaggagccggggugguacuccuucggcuucgagaucaaggacaagaagugcgacguccccugcaucgggaucgagauggugcacgacggcggcaaggagacguggcacagcgcggccaccgccaucuacugccucaugggguccggccagcugcugugggacaccgugaccggggucgacauggcccucuga

SEQ ID NO: 89692 - RNA, 1401 nt, Artificial Sequence
  derived and/or modified sequence opt1 from neuraminidase__InfluenzaB__ABN50397
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaucgacuccgacgcccugacccucagcggcgucaugguguccauggaggagccggggugguacagcuucggcuucgagaucaaggacaagaagugcgacgugcccugcaucgggaucgagaugguccacgacggcggcaagaagacguggcacuccgcggccaccgccaucuacugccugauggggagcggccagcugcucugggacaccgugaccgggguggacauggaccuguga

SEQ ID NO: 89693 - RNA, 1401 nt, Artificial Sequence
  derived and/or modified sequence opt1 from neuraminidase__InfluenzaB__ABN50408
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccucccccugccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaaggagugcaagcacuucgcccucacccacuacgccgcgcagccgggcggguacuacaacggcacccgcgaggaccggaacaagcugcgccaccugaucagcgugaagcucgggaagauccccacgguggagaacuccaucuuccacauggccgccuggagcggcuccgccugccacgacgggcgggaguggaccuacaucggcgucgacggccccgacagcaacgcccugcugaagaucaaguacggggaggcguacaccgacaccuaccacuccuacgccaacaacauccuccgcacgcaggagagcgccugcaacugcaucggcggggacugcuaccugaugaucaccgacggcagcgccuccggcaucagcgagugccgguuccugaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgcccguucgugaagcucaacgucgagaccgacacggccgagauccggcugaugugcaccgagaccuaccuggacacgccccgccccgacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccucuacgugaaguacgacggggacccguggaucgacuccgacgcccugacccugagcggcgucaugguguccauggaggagcccgggugguacagcuucggcuucgagaucaaggacaagaagugcgacgugcccugcaucgggaucgagaugguccacgacggcggcaagaagacguggcacuccgcggccaccgccaucuacugccucauggggagcggccagcugcugugggacaccgugaccgggguggacauggcccucuga

SEQ ID NO: 89694 - RNA, 1401 nt, Artificial Sequence
  derived and/or modified sequence opt1 from neuraminidase__InfluenzaB__ABN50419
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccugugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaccgacuccgacgcccucgcgcugagcggggucaugguguccauggaggagcccggcugguacagcuucggguucgagaucaaggacaagaagugcgacgugccgugcaucggcaucgagaugguccacgacggcgggaaggagacguggcacuccgccgccaccgccaucuacugccugaugggcagcgggcagcuccugugggacaccgugaccggcguggacauggcccuguga

SEQ ID NO: 89695 - RNA, 1401 nt, Artificial Sequence
  derived and/or modified sequence opt1 from neuraminidase__InfluenzaB__ABN50430
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaccgacuccgacgcccuggcgcucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcugcucugggacaccgugaccggcguggacauggcccuguga

SEQ ID NO: 89696 - RNA, 1401 nt, Artificial Sequence; identical to SEQ ID NO: 89678
  derived and/or modified sequence opt1 from neuraminidase__InfluenzaB__ABN50463

SEQ ID NO: 89697 - RNA, 1401 nt, Artificial Sequence; identical to SEQ ID NO: 89592
  derived and/or modified sequence opt1 from neuraminidase__InfluenzaB__ABN50474

SEQ ID NO: 89698 - RNA, 1401 nt, Artificial Sequence
  derived and/or modified sequence opt1 from neuraminidase__InfluenzaB__ABN50485
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgaguucaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 89699 - RNA, 1401 nt, Artificial Sequence
  derived and/or modified sequence opt1 from neuraminidase__InfluenzaB__ABN50496
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagcgggucacccuccugcugcccgagccggaguggaccuacccccgccucagcugccccggcuccacguuccagaaggcccugcugaucagcccccaccgguucggggagaccaagggcaacuccgcgccgcucaucauccgcgagcccuucaucgccugcgggcccaaggagugcaagcacuucgcccugacccacuacgccgcgcagcccggcggcuacuacaacgggacccggggcgaccgcaacaagcugcggcaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcgcacgcaggaguccgccugcaacugcaucggcgggaacugcuaccugaugaucaccgacggcagcgccagcggcguguccgagugccgguuccucaagauccgcgaggggcggaucaucaaggagaucuuccccaccggccgcaucaagcacaccgaggagugcacgugcggguucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccgacgacggcagcaucacggggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggaccccugggccgacagcgacgcgcuggccuucuccggcgucauggugagcauggaggagccggggugguacuccuucggcuucgagaucaaggacaagaagugcgacgugcccugcaucgggaucgagaugguccacgacggcggcaaggagaccuggcacagcgccgccacggccaucuacugccucaugggguccggccagcugcugugggacaccgugaccggggugaacauggcgcucuga

SEQ ID NO: 89700 - RNA, 1401 nt, Artificial Sequence
  derived and/or modified sequence opt1 from neuraminidase__InfluenzaB__ABN50507
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccucccccugccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaaggagugccgccacuucgcccucacccacuacgccgcgcagccgggcggguacuacaacggcacccgggaggaccgcaacaagcugcggcaccugaucagcgugaagcucgggaagauccccacgguggagaacuccaucuuccacauggccgccuggagcggcuccgccugccacgacgggcgcgaguggaccuacaucggcgucgacggccccgacagcaacgcccugcugaagaucaaguacggggaggcguacaccgacaccuaccacuccuacgccaacaacauccuccggacgcaggagagcgccugcaacugcaucggcggggacugcuaccugaugaucaccgacggcagcgccuccggcaucagcgagugccgcuuccugaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggccguucgugaagcucaacgucgagaccgacacggccgagauccgccugaugugcaccgagaccuaccuggacacgccccggcccgacgacggcuccaucaccgggcccugcgagagcaacggcgacaagggcuccgggggcaucaagggcggguucgugcaccagcgcauggccagcaagaucgggcggugguacucccgcaccaugagcaagaccaagcggaugggcaugggccucuacgugaaguacgacggggacccguggaucgacuccgacgcccugacccugagcggcgucaugguguccauggaggagcccgggugguacagcuucggcuucgagaucaaggacaagaagugcgacgugcccugcaucgggaucgagaugguccacgacggcggcaagaagacguggcacuccgcggccaccgccaucuacugccucauggggagcggccagcugcugugggacaccgugaccgggguggacauggcccucuga

SEQ ID NO: 89701 - RNA, 1401 nt, Artificial Sequence; identical to SEQ ID NO: 89599
  derived and/or modified sequence opt1 from neuraminidase__InfluenzaB__ABN50518

SEQ ID NO: 89702 - RNA, 1401 nt, Artificial Sequence; identical to SEQ ID NO: 89599
  derived and/or modified sequence opt1 from neuraminidase__InfluenzaB__ABN50529

SEQ ID NO: 89703 - RNA, 1401 nt, Artificial Sequence; identical to SEQ ID NO: 89592
  derived and/or modified sequence opt1 from neuraminidase__InfluenzaB__ABN50540

SEQ ID NO: 89704 - RNA, 1401 nt, Artificial Sequence; identical to SEQ ID NO: 89624
  derived and/or modified sequence opt1 from neuraminidase__InfluenzaB__ABN50551

SEQ ID NO: 89705 - RNA, 1401 nt, Artificial Sequence
  derived and/or modified sequence opt1 from neuraminidase__InfluenzaB__ABN50562
augcugcccagcaccauccagacccucacgcuguuccugaccuccggcggggcccuccugagccuguacguguccgcccuccugagcuaccugcucuacuccgacauccugcugaaguucagcccgaccaaggucaucgcgcccaccaugucccucgacuacacgaacgccagcaacgugcaggccgugaaccacuccgccaccgaggagaugaccuuccugcugcccgagcccgaguggaccuacccgcgccucagcugccagggcuccacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucagcgucaaccugggcaagauccccaccguggagaacuccaucuuccacauggccgccuggagcggguccgccugccacgacggccgcgaguggacguacaucgggguggacggccccgacagcaacgcgcugaucaagaucaaguacggcgaggccuacaccgacaccuaccacuccuacgccaacaacauccuccggacccaggagagcgccugcaacugcaucgggggcgacugcuaccugaugaucacggacgggagcgccuccggcaucagccgcugccgguuccugaagauccgcgagggccggaucaucaaggagaucuucccgaccgggcgcgucgagcacaccgaggagugcacgugcggcuucgcguccaacaagaccaucgagugcgccugccgggacaacagcuacaccgccaagcgccccuucgugaagcucaacguggagaccgacaccgccgagauccggcugaugugcacggagaccuaccuggacacgccccgccccgacgacggguccaucaccggcccgugcgagagcaacggggacaagggcaacggcgggaucaagggcggguucguccaccagcggauggccucccgcaucggccggugguacagccgcaccauguccaagaccaagcggauggggauggagcucuacgugaaguacgacggcgaccccuggaccgacagcgacgcgcuggcccccuccggcgugauggucagcauggaggagcccgggugguacuccuucggcuucgagaucaaggacaagaagugcgacgugccgugcaucgggaucgagauggugcacgacggcgggaagaagaccuggcacagcgccgccacggccaucuacugccugaugggcuccggccagcuccugugggacaccgucaccgggguggacauggcgcuguga

SEQ ID NO: 89706 - RNA, 1401 nt, Artificial Sequence; identical to SEQ ID NO: 89695
  derived and/or modified sequence opt1 from neuraminidase__InfluenzaB__ABN50573

SEQ ID NO: 89707 - RNA, 1401 nt, Artificial Sequence
  derived and/or modified sequence opt1 from neuraminidase__InfluenzaB__ABN50584
augcugcccagcaccauccagacccucacgcuguuccugaccuccggcggggugcuccugagccuguacgucuccgccagccucuccuaccugcuguacagcgacauccuccugaaguucuccccgaccgagaucaccgccagcacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggaguccgacaccgccgagauccgccugaugugcacggagaccuaccucgacacgccccggccggacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucuccggggugauggugagcauggaggagcccggcugguacuccuucggguucgagaucaaggacaagaagugcgacgucccgugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 89708 - RNA, 1401 nt, Artificial Sequence; identical to SEQ ID NO: 89592
  derived and/or modified sequence opt1 from neuraminidase__InfluenzaB__ABN50595

SEQ ID NO: 89709 - RNA, 1398 nt, Artificial Sequence
  derived and/or modified sequence opt1 from neuraminidase__InfluenzaB__ABN50606
augcugcccagcaccauccagacccucacgcuguuccugaccuccggcggggugcuccugagccuguacgucuccgccagccucuccuaccugcuguacagcgacauccuccugcgcuucuccagcaagaucaccgccccgaccaugacgcuggacugcgcgaacgccuccaacgugcaggccgugaaccggagcgccaccaaggagaugaccuuccuccugcccgagcccgaguggaccuacccccgccuguccugccagggcagcacguuccagaaggcccuccugaucuccccgcaccgguucggggaggcgcgcggcaacagcgcgccccugaucauccgggagcccuucaucgccugcgggcccaaggagugcaagcacuucgcccucacccacuacgccgcccagccgggcggcuacuacaacgggacccgcgaggaccggaacaagcugcgccaccugaucuccgucaagcucggcaagauccccaccguggagaacagcaucuuccacauggccgccugguccgggagcgccugccacgacggccgggaguggacguacaucgggguggacggccccgacuccaacgcgcugaucaagaucaaguacggcgaggccuacaccgacaccuaccacagcuacgccaacaacauccugcgcacccaggagagcgccugcaacugcaucgggggcgacugcuaccucaugaucacggacggguccgccagcggcaucuccgagugccgguuccugaagauccgcgagggccggaucaucaaggagaucuuccccaccgggcgcgucgagcacaccgaggagugcacgugcggcuucgcgagcaacaagaccaucgagugcgccugccgggacaacuccuacaccgccaagcgcccguucgugaagcugaacguggagaccgacaccgccgagauccggcucaugugcacggagaccuaccuggacacgccccgccccgacgacgggagcaucaccggccccugcgaguccgacggggacaagggccggggcgggaucaagggcggguucguccaccagcgcauggccagcaagaucggccggugguacucccgcaccaugagcaagaccgagcgcauggggauggagcuguacgugaaguacgacggcgacccguggaccgacuccgacgcgcucgcccccagcggcgugauggucuccaugaaggagcccgggugguacagcuucggcuucgagaucaaggacaagaagugcgacgugcccugcaucgggaucgagauggugcacgacggcgggaagaagaccuggcacuccgccgccacggccaucuacugccugaugggcagcggccagcugcucugggacaccgucaccgggguggacauggcgcuguga

SEQ ID NO: 89710 - RNA, 1398 nt, Artificial Sequence
  derived and/or modified sequence opt1 from neuraminidase__InfluenzaB__ABN50628
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaugucccucgacugcgcgaacgccagcaacgugcaggccgugaaccacuccgccaccaaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgucaaccugggcaagauccccaccguggagaacuccaucuuccacauggccgccuggagcggguccgccugccacgacggccgcgaguggaccuacaucgggguggacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcgggucgagcacacggaggagugcacgugcggcuucgcguccaacaagaccaucgagugcgccugccgcgacaacagcuacaccgccaagcggcccuucgugaagcucaacguggagaccgacaccgccgagauccgccugaugugcaccgagaccuaccuggacacgccccggcccgacgacggguccaucaccggcccgugcgagagcaacggggacaagggccgcggcggggucaagggcggguucgugcaccagcggauggccuccaagaucggccgcugguacagccggaccauguccaagaccgagcgcauggggauggagcucuacgugaaguacgacggcgaccccuggacggacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 89711 - RNA, 1398 nt, Artificial Sequence
  derived and/or modified sequence opt1 from neuraminidase__InfluenzaB__ABN50639
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaugucccucgacugcgcgaacgccagcaacgugcaggccgugaaccacuccgccaccaaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgucaagcugggcaagauccccaccguggagaacuccaucuuccacauggccgccuggagcggguccgccugccacgacggccgcgaguggaccuacaucgggguggacggccccgacagcaacgcgcuggucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcggguggagcacacggaggagugcacgugcggcuucgcguccaacaagaccaucgagugcgccugccgcgacaacagcuacaccgccaagcggcccuucgugaagcucaacgucgagaccgacaccgccgagauccgccugaugugcaccgagaccuaccuggacacgccccggcccgacgacggguccaucaccggcccgugcgagagcaacggggacaagggccgcggcggggugaagggcggguucgugcaccagcggauggccuccaagaucggccgcugguacagccggaccauguccaagaccgagcgcauggggauggagcucuacgucaaguacgacggcgaccccuggacggacagcgacgcgcuggcccccuccggcgugauggugagcauggaggagcccgggugguacuccuucggcuucgagaucaaggacaagaagugcgacgucccgugcaucgggaucgagauggugcacgacggcgggaagaagaccuggcacagcgccgccaccgccaucuacugccugaugggcuccggccagcuccugugggacaccgugacgggggucgacauggcgcuguga

SEQ ID NO: 89712 - RNA, 1398 nt, Artificial Sequence
  derived and/or modified sequence opt1 from neuraminidase__InfluenzaB__ABN50650
augcugcccagcaccauccagacccucacgcuguuccugaccuccggcggggugcuccugagccuguacgucuccgcccuccugagcuaccugcucuacuccgacgugcugcugaaguucagcccgaagaucaucgcccccaccaugucccucgacugcgcgaacgccagcaacgugcaggccgucaaccacuccgccaccgaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcggguggagcacacggaggagugcacgugcggcuucgcguccaacaagaccaucgagugcgccugccgcgacaacagcuacaccgccaagcggcccuucgugaagcucaacgucgagaccgacaccgccgagauccgccugaugugcaccgagaccuaccuggacacgccccggcccgacgacggguccaucaccggcccgugcgagagcaacggggacaagggccacggcgggaucaagggcggguucgugcaccagcgcauggccuccaagaucggccggugguacagccgcaccauguccaagaccaagcggauggggauggagcucuacgugaaguacgacggcgaccccuggacggacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 89713 - RNA, 1398 nt, Artificial Sequence
  derived and/or modified sequence opt1 from neuraminidase__InfluenzaB__ABN50661
augcugcccagcaccauccagacccucacgcuguuccugaccuccggcggggugcuccugagccuguacgucuccgcccuccugagcuaccugcucuacuccgacgugcugcugaaguucagcccgaagaugaucgcccccaccaugucccucgacugcgcgaacgccagcaacgugcaggccgucaaccacuccgccaccgaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcggguggagcacacggaggagugcacgugcggcuucgcguccaacaagaccaucgagugcgccugccgcgacaacagcuacaccgccaagcggcccuucgugaagcucaacgucgagaccgacaccgccgagauccgccugaugugcaccgagaccuaccuggacacgccccggcccgacgacggguccaucaccggcccgugcgagagcaacggggacaagggccacggcgggaucaagggcggguucgugcaccagcgcauggccuccaagaucggccggugguacagccgcaccauguccaagaccaagcggauggggauggagcucuacgugaaguacgacggcgaccccuggacggacagcgacgcgcuggcccccuccggcgucauggugagcauggaggagcccgggugguacuccuucggcuucgagaucaaggacaagaagugcgacgugccgugcaucgggaucgagaugguccacgacggcgggaagaagaccuggcacagcgccgccaccgccaucuacugccugaugggcuccggccagcuccugugggacaccgugacggggguggacauggcgcuguga

SEQ ID NO: 89714 - RNA, 1401 nt, Artificial Sequence
  derived and/or modified sequence opt1 from neuraminidase__InfluenzaB__ABN50683
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagacccgggggaacuccgcgccgcucaucauccgcgagcccuucaucgccugcggccccaaggagugcaagcacuucgcccugacccacuacgccgcgcagcccggcggguacuacaacggcacccgggaggaccgcaacaagcugcggcaccucaucagcgugaagcuggggaagaucccgacgguggagaacuccaucuuccacauggccgccuggagcggcuccgccugccacgacgggcgcgaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcggggacugcuaccugaugaucaccgacggcagcgccuccggcaucagcaagugccgcuuccucaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggccucgggggcaucaagggcggguucgugcaccagcgcauggccuccaagaucgggcggugguacagccgcaccauguccaagaccaagcggaugggcauggagcuguacgugaaguacgacggcgaccccuggaccgacagcgacgcccuggcgcuguccggggucauggugccgauggaggagcccggcugguacagcuucggguucgagaucaaggacaagaagugcgacgugcccugcaucggcaucgagaugguccacgacgggggcaagaagacguggcacuccgccgccaccgccaucuacugccugaugggcagcgggcagcuccugugggacaccgugaccggcguggacauggcccuguga

SEQ ID NO: 89715 - RNA, 1401 nt, Artificial Sequence
  derived and/or modified sequence opt1 from neuraminidase__InfluenzaB__ABN50694
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagacccgggggaacuccgcgccgcucaucauccgcgagcccuucaucgccugcggccccaaggagugcaagcacuucgcccugacccacuacgccgcgcagcccggcggguacuacaacggcacccgggaggaccgcaacaagcugcggcaccucaucagcgugaagcuggggaagaucccgacgguggagaacuccaucuuccacauggccgccuggagcggcuccgccugccacgacgggcgcgaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcggggacugcuaccugaugaucaccgacggcagcgccuccggcaucagcaagugccgcuuccucaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaagaagacguggcacuccgccgccaccgccaucuacugccugauggggagcggccagcugcucugggacaccgugaccgggguggacauggcccuguga

SEQ ID NO: 89716 - RNA, 1398 nt, Artificial Sequence
  derived and/or modified sequence opt1 from neuraminidase__InfluenzaB__ABN50705
augcugcccagcaccauccagacccucacgcuguuccugacccucggcggggugcugcugucccucuacgucagcgcccugcuguccuaccuccuguacagcgacgugcugcucaaguucuccccgaagaugaucgcccccaccaugagccuggacugcgcgaacgccuccaacgugcaggccgucaaccacagcgccaccgaggagaugacguuccugcuccccgagcccgaguggaccuacccgcgccuguccugccagggcagcaccuuccagaaggcccugcucaucagcccccaccgguucggggaggcgaagggcaacuccgcgccccugaucauccgcgagcccuucaucgccugcgggccgaaggagugcaagcacuucgcccugacccacuacgccgcccagcccggcggcuacuacaacgggacgcgggaggaccgcaacaagcuccggcaccugaucuccgugaaccugggcaagauccccaccguggagaacagcaucuuccacauggccgccugguccgggagcgccugccacgacggccgcgaguggaccuacaucggggucgacggccccgacuccaacgcgcucaucaagaucaaguacggcgaggccuacaccgacacguaccacagcuacgccaacaacauccugcggacccaggaguccgccugcaacugcaucgggggcgacugcuaccugaugaucaccgacgggagcgccagcggcaucuccaagugccgcuuccucaagauccgggagggccgcaucaucaaggagaucuucccgaccgggcggguggagcacacggaggagugcacgugcggcuucgcgagcaacaagaccaucgagugcgccugccgcgacaacuccuacaccgccaagcggcccuucgugaagcugaacgucgagaccgacaccgccgagauccgccugaugugcaccgagaccuaccucgacacgccccggcccgacgacgggagcaucaccggcccgugcgaguccaacggggacaagggccacggcgggaucaagggcggguucgugcaccagcgcauggccagcaagaucggccggugguacucccgcaccaugagcaagaccaagcggauggggauggagcuguacgugaaguacgacggcgaccccuggacggacuccgacgcgcuggcccccagcggcgucaugguguccauggaggagcccgggugguacagcuucggcuucgagaucaaggacaagaagugcgacgugccgugcaucgggaucgagaugguccacgacggcgggaagaagaccuggcacuccgccgccaccgccaucuacugccucaugggcagcggccagcugcugugggacaccgugacggggguggacauggcgcucuga

SEQ ID NO: 89717 - RNA, 1401 nt, Artificial Sequence
  derived and/or modified sequence opt1 from neuraminidase__InfluenzaB__ABN50716
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccuggacugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagacccggggcaacuccgcgccgcucaucauccgcgagcccuucaucgccugcggccccaaggagugcaagcacuucgcccugacccacuacgccgcgcagcccgggggcuacuacaacgggacccgggaggaccgcaacaagcugcggcaccucaucagcgugaagcugggcaagaucccgacgguggagaacuccaucuuccacauggccgccuggagcggguccgccugccacgacggccgcgaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcgacugcuaccugaugaucaccgacggcagcgccuccgggaucagcaagugccgcuuccucaagauccgggagggccgcaucaucaaggagaucuuccccaccgggcggguggagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaccgacuccgacgcccuggcgcucagcggggucaugguguccauggaggagccgggcugguacagcuucggguucgagaucaaggacaagaagugcgacgugcccugcaucggcaucgagaugguccacgacggcgggaagaagacguggcacuccgccgccaccgccaucuacugccugaugggcagcgggcagcugcucugggacaccgugaccggcguggacauggcccuguga

SEQ ID NO: 89718 - RNA, 1401 nt, Artificial Sequence
  derived and/or modified sequence opt1 from neuraminidase__InfluenzaB__ABN50727
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaagaagacguggcacuccgccgccaccgccaucuacugccugauggggagcggccagcugcucugggacaccgugaccgggguggacauggcccuguga

SEQ ID NO: 89719 - RNA, 1401 nt, Artificial Sequence; identical to SEQ ID NO: 89661
  derived and/or modified sequence opt1 from neuraminidase__InfluenzaB__ABN50738

SEQ ID NO: 89720 - RNA, 1401 nt, Artificial Sequence
  derived and/or modified sequence opt1 from neuraminidase__InfluenzaB__ABN50749
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcugcucugggacaccgugaccggcguggacauggcgcuguga

SEQ ID NO: 89721 - RNA, 1398 nt, Artificial Sequence
  derived and/or modified sequence opt1 from neuraminidase__InfluenzaB__ABN51188
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaugcuccuggacugcgcgaacgccuccaacgugcaggccgugaaccacagcgccaccaaggagaugacguuccugcuccccgagcccgaguggaccuacccgcgccuguccugccagggcagcaccuuccagaaggcccugcucaucagcccccaccgguucggggaggcgaagggcaacuccgcgccccugaucauccgcgagcccuucaucgccugcgggccgaaggagugcaagcacuucgcccugacccacuacgccgcccagcccggcggcuacuacaacgggacgcgggaggaccgcaacaagcuccggcaccugaucuccgucaaccugggcaagauccccaccguggagaacagcaucuuccacauggccgccugguccgggagcgccugccacgacggccgcgaguggaccuacaucgggguggacggccccgacuccaacgcgcucaucaagaucaaguacggcgaggccuacaccgacacguaccacagcuacgccaacaacauccugcggacccaggaguccgccugcaacugcaucgggggcgacugcuaccugaugaucaccgacgggagcgccagcggcaucuccaagugccgcuuccucaagauccgggagggccgcaucaucaaggagaucuucccgaccgggcgggucgagcacacggaggagugcacgugcggcuucgcgagcaacaagaccaucgagugcgccugccgcgacaacuccuacaccgccaagcggcccuucgugaagcugaacguggagaccgacaccgccgagauccgccugaugugcaccgagaccuaccucgacacgccccggcccgacgacgggagcaucaccggcccgugcgaguccaacggggacaagggccgcggcggggucaagggcggguucgugcaccagcggauggccagcaagaucggccgcugguacucccggaccaugagcaagaccgagcgcauggggauggagcuguacgugaaguacgacggcgaccccuggacggacuccgacgcgcuggcccccagcggcgucaugguguccauggaggagcccgggugguacagcuucggcuucgagaucaaggacaagaagugcgacgugccgugcaucgggaucgagaugguccacgacggcgggaagaagaccuggcacuccgccgccaccgccaucuacugccucaugggcagcggccagcugcugugggacaccgugacggggguggacauggcgcucuga

SEQ ID NO: 89722 - RNA, 1398 nt, Artificial Sequence; identical to SEQ ID NO: 89710
  derived and/or modified sequence opt1 from neuraminidase__InfluenzaB__ABN51199

SEQ ID NO: 89723 - RNA, 1401 nt, Artificial Sequence
  derived and/or modified sequence opt1 from neuraminidase__InfluenzaB__ABN58665
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccaugucccucgacugcgcgaacgccagcaacgugcaggccgugaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgucaaccugggcaagauccccaccguggagaacuccaucuuccacauggccgccuggagcggguccgccugccacgacggccgcgaguggaccuacaucgggguggacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgacggggcgggucgagcacaccgaggagugcacgugcggcuucgcguccaacaagaccaucgagugcgccugccgcgacaacagcuacaccgccaagcggcccuucgugaagcucaacguggagaccgacaccgccgagauccgccugaugugcaccgagacguaccuggacacgccccggcccgacgacggguccaucaccggcccgugcgagagcaacgggggcaagggcuccgggggcaucaagggcggguucguccaccagcgcauggccagcaagaucgggcggugguacucccgcaccaugagcaagaccaagcggaugggcauggagcucuacgugaaguacgacggcgaccccuggaccgacuccgacgcgcuggcccccagcggggugauggucuccauggaggagcccggcugguacagcuucggguucgagaucaaggacaagaagugcgacgugccgugcaucggcaucgagauggugcacgacgggggcaagaagaccuggcacuccgccgccaccgccaucuacugccugaugggcagcgggcagcuccugugggacacggucaccggcguggacauggcgcuguga

SEQ ID NO: 89724 - RNA, 1401 nt, Artificial Sequence; identical to SEQ ID NO: 89611
  derived and/or modified sequence opt1 from neuraminidase__InfluenzaB__ABN59449

SEQ ID NO: 89725 - RNA, 1398 nt, Artificial Sequence; identical to SEQ ID NO: 89689
  derived and/or modified sequence opt1 from neuraminidase__InfluenzaB__ABR15999

SEQ ID NO: 89726 - RNA, 1401 nt, Artificial Sequence; identical to SEQ ID NO: 89718
  derived and/or modified sequence opt1 from neuraminidase__InfluenzaB__ABR16010

SEQ ID NO: 89727 - RNA, 1401 nt, Artificial Sequence
  derived and/or modified sequence opt1 from neuraminidase__InfluenzaB__ABR16021
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccggaagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89728 - RNA, 1401 nt, Artificial Sequence; identical to SEQ ID NO: 89643
  derived and/or modified sequence opt1 from neuraminidase__InfluenzaB__ACA64903

SEQ ID NO: 89729 - RNA, 1401 nt, Artificial Sequence
  derived and/or modified sequence opt1 from neuraminidase__InfluenzaB__ACA64914
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggacgagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 89730 - RNA, 1401 nt, Artificial Sequence; identical to SEQ ID NO: 89643
  derived and/or modified sequence opt1 from neuraminidase__InfluenzaB__ACA64936

SEQ ID NO: 89731 - RNA, 1401 nt, Artificial Sequence
  derived and/or modified sequence opt1 from neuraminidase__InfluenzaB__ACA64969
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccgccaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaagaucaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggcggacagcgacgcccuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgcgaucuacugccucaugggcuccgggcagcugcugugggacacggugaccggcgucgacauggcccucuga

SEQ ID NO: 89732 - RNA, 1401 nt, Artificial Sequence
  derived and/or modified sequence opt1 from neuraminidase__InfluenzaB__ACA64980
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccagcaagauccugcggacgcaggagagcgccugcaacugcaucgggggcaacugcuaccugaugaucaccgacggcuccgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagcccggcugguacuccuucggguucgagaucaaggacaagaagugcgacgucccgugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89733 - RNA, 1401 nt, Artificial Sequence
  derived and/or modified sequence opt1 from neuraminidase__InfluenzaB__ACA64991
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucgggggcgugaugguguccaugaaggagccggggugguacagcuucggcuucgagaucaaggacaagaagugcgacguccccugcaucggcaucgagauggugcacgacgggggcaaggagaccuggcacuccgccgccacggccaucuacugccucauggggagcggccagcugcugugggacaccgugaccggcgucgacauggcgcucuga

SEQ ID NO: 89734 - RNA, 1401 nt, Artificial Sequence; identical to SEQ ID NO: 89643
  derived and/or modified sequence opt1 from neuraminidase__InfluenzaB__ACA65013

SEQ ID NO: 89735 - RNA, 1401 nt, Artificial Sequence; identical to SEQ ID NO: 89643
  derived and/or modified sequence opt1 from neuraminidase__InfluenzaB__ACA65024

SEQ ID NO: 89736 - RNA, 1401 nt, Artificial Sequence
  derived and/or modified sequence opt1 from neuraminidase__InfluenzaB__ACA65035
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccuccaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 89737 - RNA, 1401 nt, Artificial Sequence; identical to SEQ ID NO: 89643
  derived and/or modified sequence opt1 from neuraminidase__InfluenzaB__ACA65046

SEQ ID NO: 89738 - RNA, 1401 nt, Artificial Sequence
  derived and/or modified sequence opt1 from neuraminidase__InfluenzaB__ACA65057
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggaggccgacaccgccgagauccgccugaugugcacggacaccuaccucgacaccccgcggcccgacgacgggagcaucaccggccccugcgaguucaacggcgacaagggguccggcgggaucaagggcggguucgugcaccagcgcauggccagcaagaucggccggugguacucccgcacgaugagcaagaccgagcggaugggcauggggcuguacgucaaguacgacggcgaccccugggcggacuccgacgcccuggccuucagcggggugaugguguccaugaaggagccgggcugguacagcuucggguucgagaucaaggacaagaagugcgacguccccugcaucggcaucgagauggugcacgacggcgggaaggagaccuggcacuccgccgccaccgcgaucuacugccucaugggcagcgggcagcugcugugggacacggugaccggcgucgacauggcccucuga

SEQ ID NO: 89739 - RNA, 1401 nt, Artificial Sequence; identical to SEQ ID NO: 89643
  derived and/or modified sequence opt1 from neuraminidase__InfluenzaB__ACA65068

SEQ ID NO: 89740 - RNA, 1401 nt, Artificial Sequence; identical to SEQ ID NO: 89643
  derived and/or modified sequence opt1 from neuraminidase__InfluenzaB__ACA65079

SEQ ID NO: 89741 - RNA, 1401 nt, Artificial Sequence; identical to SEQ ID NO: 89643
  derived and/or modified sequence opt1 from neuraminidase__InfluenzaB__ACA65090

SEQ ID NO: 89742 - RNA, 1401 nt, Artificial Sequence; identical to SEQ ID NO: 89643
  derived and/or modified sequence opt1 from neuraminidase__InfluenzaB__ACA65101

SEQ ID NO: 89743 - RNA, 1401 nt, Artificial Sequence
  derived and/or modified sequence opt1 from neuraminidase__InfluenzaB__ACA96567
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggagugggccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaagaucaaguacggcgaggccuacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggcggacagcgacgcccuggccuucuccgggaucauggugagcaugaaggagccgggcugguacuccuucggguucgagaucaaggacaagaagugcgacgugcccugcaucggcaucgagaugguccacgacggcgggaaggagaccuggcacagcgccgccaccgcgaucuacugccucaugggcuccgggcagcugcugugggacacggugaccggcguggacauggcccucuga

SEQ ID NO: 89744 - RNA, 1401 nt, Artificial Sequence; identical to SEQ ID NO: 89643
  derived and/or modified sequence opt1 from neuraminidase__InfluenzaB__ACA96578

SEQ ID NO: 89745 - RNA, 1401 nt, Artificial Sequence; identical to SEQ ID NO: 89731
  derived and/or modified sequence opt1 from neuraminidase__InfluenzaB__ACA96589

SEQ ID NO: 89746 - RNA, 1401 nt, Artificial Sequence; identical to SEQ ID NO: 89643
  derived and/or modified sequence opt1 from neuraminidase__InfluenzaB__ACA96600

SEQ ID NO: 89747 - RNA, 1401 nt, Artificial Sequence
  derived and/or modified sequence opt1 from neuraminidase__InfluenzaB__ACA96611
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacuacgcgaacgccagcaacgugcacgccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcggcugcugugggacaccgugaccggcgucgacauggcgcucuga

SEQ ID NO: 89748 - RNA, 1401 nt, Artificial Sequence
  derived and/or modified sequence opt1 from neuraminidase__InfluenzaB__ACA96622
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucaucggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 89749 - RNA, 1401 nt, Artificial Sequence; identical to SEQ ID NO: 89731
  derived and/or modified sequence opt1 from neuraminidase__InfluenzaB__ACA96633

SEQ ID NO: 89750 - RNA, 1401 nt, Artificial Sequence
  derived and/or modified sequence opt1 from neuraminidase__InfluenzaB__ACA96644
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcaucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcuggccuucuccggggucaugaucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89751 - RNA, 1401 nt, Artificial Sequence
  derived and/or modified sequence opt1 from neuraminidase__InfluenzaB__ACA96655
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 89752 - RNA, 1401 nt, Artificial Sequence
  derived and/or modified sequence opt1 from neuraminidase__InfluenzaB__ACA96666
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaagauccugcggacgcaggaguccgccugcaacugcaucggcgggaacugcuaccugaugaucaccgacggcagcgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacggcagcaucacggggcccugcgaguccaacggcgaccgcggcagcgggggcaucaagggcggguucgugcaccagcggauggccuccaagaucgggcgcugguacagccggaccauguccaagaccgagcgcaugggcaugggccuguacgucaaguacgacggggaccccugggccgacagcgacgcgcuggccuucuccggcgugauggugagcaugaaggagccggggugguacuccuucggcuucgagaucaaggacaagaagugcgacguccccugcaucgggaucgagauggugcacgacgacggcaaggagaccuggcacagcgccgccacggccaucuacugccucaugggcuccgggcagcugcugugggacaccgugaccggcgucgacauggcgcucuga

SEQ ID NO: 89753 - RNA, 1401 nt, Artificial Sequence
  derived and/or modified sequence opt1 from neuraminidase__InfluenzaB__ACD56581
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacaccgacacguaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcugaacgucgagaccgacaccgccgagauccgccugaugugcaccgagaccuaccucgacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccuguacgugaaguacgacggggaccccuggacggacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 89754 - RNA, 1401 nt, Artificial Sequence
  derived and/or modified sequence opt1 from neuraminidase__InfluenzaB__ACF33793
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaucccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 89755 - RNA, 1401 nt, Artificial Sequence
  derived and/or modified sequence opt1 from neuraminidase__InfluenzaB__ACF33795
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagaagaugggcauggggcuguacgugaaguacgacggcgagcccugggccgacagcgacgcgcugaccuucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcgugaacauggcccucuga

SEQ ID NO: 89756 - RNA, 1401 nt, Artificial Sequence
  derived and/or modified sequence opt1 from neuraminidase__InfluenzaB__ACF33797
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacacgcugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgucaagcugaacguggagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucaucggggugaugguguccauggaggagccgggcugguacagcuucggguucgagaucaaggacaagaagugcgacguccccugcaucggcaucgagauggugcacgacggcgggaaggagacguggcacuccgccgccaccgccaucuacugccugaugggcagcgggcagcugcucugggacaccgugaccggcgucaacauggcgcuguga

SEQ ID NO: 89757 - RNA, 1401 nt, Artificial Sequence; identical to SEQ ID NO: 89736
  derived and/or modified sequence opt1 from neuraminidase__InfluenzaB__ACF41662

SEQ ID NO: 89758 - RNA, 1401 nt, Artificial Sequence
  derived and/or modified sequence opt1 from neuraminidase__InfluenzaB__ACF54140
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcaccaagggggaccgcaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgaccgggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89759 - RNA, 1401 nt, Artificial Sequence
  derived and/or modified sequence opt1 from neuraminidase__InfluenzaB__ACF54151
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgggaaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggccuucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcgugaacauggcgcucuga
